US011970745B2

(12) United States Patent
Dietrich

(10) Patent No.: US 11,970,745 B2
(45) Date of Patent: Apr. 30, 2024

(54) METHOD FOR ASSESSING A PROGNOSIS AND PREDICTING A RESPONSE OF PATIENTS WITH MALIGNANT DISEASES TO IMMUNOTHERAPY

(71) Applicant: Dimo Dietrich, Berlin (DE)

(72) Inventor: Dimo Dietrich, Berlin (DE)

( * ) Notice: Subject to any disclaimer, the term of this patent is extended or adjusted under 35 U.S.C. 154(b) by 142 days.

(21) Appl. No.: 17/330,817

(22) Filed: May 26, 2021

(65) Prior Publication Data

US 2021/0285058 A1 Sep. 16, 2021

Related U.S. Application Data

(63) Continuation of application No. 16/098,758, filed as application No. PCT/EP2017/061612 on May 15, 2017, now abandoned.

(30) Foreign Application Priority Data

May 16, 2016 (DE) ..................... 10 2016 005 947.8

(51) Int. Cl.
*C12Q 1/6886* (2018.01)

(52) U.S. Cl.
CPC ..... *C12Q 1/6886* (2013.01); *C12Q 2600/106* (2013.01); *C12Q 2600/118* (2013.01); *C12Q 2600/154* (2013.01)

(58) Field of Classification Search
None
See application file for complete search history.

(56) References Cited

U.S. PATENT DOCUMENTS

| 10,570,455 | B2 | 2/2020 | Su et al. | |
|---|---|---|---|---|
| 11,254,987 | B2* | 2/2022 | Kadel ................... | C12Q 1/6886 |
| 11,685,955 | B2 | 6/2023 | Dietrich | |
| 2006/0121467 | A1 | 6/2006 | Foekens et al. | |
| 2012/0039993 | A1 | 2/2012 | Otto et al. | |
| 2013/0302363 | A1 | 11/2013 | Vlassenbroeck et al. | |
| 2014/0011702 | A1 | 1/2014 | Mosser et al. | |
| 2015/0012637 | A1 | 1/2015 | Katsumata | |
| 2015/0051084 | A1 | 2/2015 | Lorincz et al. | |
| 2015/0126374 | A1 | 5/2015 | Califano et al. | |
| 2016/0193239 | A1 | 7/2016 | Baylin et al. | |
| 2016/0326593 | A1 | 11/2016 | Clement et al. | |
| 2017/0058355 | A1 | 3/2017 | Kanai et al. | |
| 2018/0216196 | A1* | 8/2018 | Kadel ................... | C12Q 1/6886 |
| 2019/0249258 | A1 | 8/2019 | Dietrich | |

FOREIGN PATENT DOCUMENTS

| JP | 2014505475 | A | 3/2014 |
|---|---|---|---|
| WO | 1997/046705 | A1 | 12/1997 |
| WO | 2002/072880 | A2 | 9/2002 |
| WO | 2010/086388 | A1 | 8/2010 |
| WO | 2011/037936 | A2 | 3/2011 |
| WO | 2011/051414 | A1 | 5/2011 |
| WO | 2012/045888 | A1 | 4/2012 |
| WO | 2012/098215 | A1 | 7/2012 |
| WO | 2013/082043 | A1 | 6/2013 |
| WO | 2014/051006 | A1 | 4/2014 |
| WO | 2015/035112 | A1 | 3/2015 |
| WO | 2015/077717 | A1 | 5/2015 |
| WO | 2016/196381 | A1 | 12/2016 |

OTHER PUBLICATIONS

Robert et al Nejm. 2015. 372: 2521-2532 (Year: 2015).*
Goltz et al. Oncoimmunology. Nov. 10, 2016. 6(1): e1257454 (Year: 2016).*
Daud et al J Clin Oncol. Oct. 10, 2016. 34:4102-4109 (Year: 2016).*
Goltz et al. 44th Annual Meeting of the Arbeitsgemeinschaft Dermatologische Forschung (ADF). Mar. 9-11, 2017, available via URL: <onlinelibrary.wiley.com/doi/epdf/10.1111/exd.13280>, p. E83, Abstract P193 (OP03/01) (Year: 2017).*
Hugo et al Cell. Mar. 2016. 165(1): 35-44 (Year: 2016).*
Australian Patent Application No. 2017267184, Examination Report dated Mar. 12, 2020, 7pgs.
Benson D.A. et al.: GenBank. Nucleic Acids Research (Jan. 2013), 41, D36-D42.
Berman, B. P. et al.: Regions of focal DNA hypermethylation and long-range hypomethylation in colorectalcancer coincide with nuclear lamina-associated domains. Nat. Genet., vol. 44, 2011, pp. 40-46.
Chang, et al., Microsatellite Instability: A Predictive Biomarker for Cancer Immunotherapy, e Research Article, Appl Immunohistochem Mol Morphol, vol. 26, No. 2, Feb. 2018, 7 pgs.
Dedeurwaerder, S. et al.: DNA methylation profiling reveals a predominant immune component in breast cancers. EMBO Mol Med. 2011, 3, 726-741.
Gettinger, S. N. et al.: Molecular, immune and histopathological characterization of NSCLC based on PDL1 expression on tumor and immune cells and association with response to the anti-PDL1 antibody MPDL3280A. Journal of Clinical Oncology 33, No. 15_suppl, 2015, 3015-3015.
Gevensleben, et al.: PD-L1 promoter methylation is a prognostic biomarker for biochemical recurrence-free survival in prostate cancer patients for the following radical prostatectomy. Oncotarget. Nov. 7, 2016. 7(48): 79943-79955 (Year: 2016).

(Continued)

*Primary Examiner* — Carla J Myers
(74) *Attorney, Agent, or Firm* — Alan J. Morrison

(57) ABSTRACT

The invention relates to, among others, a method for assessing a prognosis of a patient with a malignant disease and/or for predicting the response of a patient with a malignant disease to immunotherapy. For this purpose, a DNA methylation analysis is carried out on at least one immunoregulatory gene of cells of the malignant disease and/or T lymphocytes which interact with the cells of the malignant disease, said gene coding for an immune checkpoint selected from B7 proteins and the receptors thereof, MHC-peptide complex-binding co-receptors, the members of the tumor necrosis factor receptor superfamily TNFRSF9, CD40, TNFRSF4, TNFRSF18, and CD27, the members of the immunoglobulin superfamily TIGIT, BTLA, HAVCR2, BTNL2 and CD48, and the andenosine-binding adenosine 2A receptor.

14 Claims, 37 Drawing Sheets

Specification includes a Sequence Listing.

(56) References Cited

OTHER PUBLICATIONS

Hartmann, O. et al.: DNA methylation markers predict outcome in node-positive, estrogen receptor-positivebreast cancer with adjuvant anthracycline-based chemotherapy. Clin. Cancer Res. (2009), 15 (1), 315-23.
Johnson, M. D. et al.: Single Nucleotide Analysis of Cytosine Methylation by Whole-Genome ShotgunBisulfite Sequencing. Curr. Protoc. Mol. Biol., vol. 99, 2012, pp. 21.23.1-21.23.28.
Kleffel, S. et al.: Melanoma Cell-Intrinsic PD-1 Receptor Functions Promote Tumor Growth. Cell, 2015, 162 (6):1242-56.
Kowanetz, M. et al.: PD-L1 as a predictive biomarker for atezolizumab (MPDL3280A; anti-PDL1) in non-small cell lung cancer (NSCLC), Cancer Immunology Research, 2016, vol. 4, Issue 1, Supplement, Abstract A017, 1-5.
Leung, J. et al.: The CD28-B7 family in anti-tumor immunity: Emergingconcepts in cancer immunotherapy. Immune Netw. (2014), 14 (6), 265-76.
Lister, R. et al.: Human DNA methylomes at base resolution show widespread epigenomicdifferences. Nature, vol. 462, 2009, pp. 315-322.
Luan, Z.M. et al.: Prediction efficiency of PITX2 DNA methylation for prostate cancersurvival. Genet. Mol. Res. (Apr. 25, 2016), 15 (2), 1-7.
Phé, V. et al.: Interest of methylated genes as biomarkers in urothelial cell carcinomas ofthe urinary tract. BJU Int. (Oct. 1, 2009), 104 (7), 896-901.
Rainbow, D.B. et al.: Epigenetic analysis of regulatory T cells using multiplex bisulfitesequencing. Eur. J. Immunol. (2015), 45 (11), 3200-3.
Schmid, P. et al.: NSCLC with high PD-L1 expression on tumor cells or tumor infiltrating immune cells represent distinct cancer subtypes. European Journal of Cancer, 2015, 51, Supplement 3, Poster 3017, p. S602.
Search Report for Indian application No. 201847047147 dated Jul. 17, 2020, 8 pgs.
Taube, et al., Association of PD-1, PD-1 Ligands, and Other Features of the Tumor Immune Microenvironment with Response to Anti-PD-1 Therapy, American Association for Cancer Research, Clinical Cancer Research, 20(19) Oct. 1, 2014, 12 pgs.
Thompson et al.: Clustal W: improving the sensitivity of progressive multiple sequence alignmentthrough sequence weighting, position-specific gap penalties and weight matrix choice. Nucleic AcidsResearch (Nov. 11, 1994), 22 (22), 4673-80.
Tian Haorui: "Study on the treatment of esophageal cancer cell line KYSE450 with anti-PDL1 monoclonal antibody combined with 5-azacytidine", Full text database of Chinese excellent master's thesis, Issue 4, E072-224, publication date: Apr. 15, 2016.
Topalian, et al., Safety, Activity, and Immune Correlates of Anti-PD-1 Antibody in Cancer, The New England Journal of Medicine, Jun. 28, 2012, vol. 366, No. 26, 12 pgs.
Wrangle, J. et al.: Alterations of immune response of non-small cell lung cancer with Azacytidine, Oncotarget, vol. 4,2013, 2067-2079.
Xu, Z. et al.: Comprehensive molecular profiling of the B7 family of immune-regulatoryligands in breast cancer. Oncoimmunology (Jul. 11, 2016), 5 (8):e1207841.
Yang, H. et al. Expression of immune checkpoints PD-L1, PD-L2, PD-1 and CTLA4 predict for prognosis and resistance tohypomethylating agents (HMAs) in myelodysplastic syndromes (MDS). Database Biosis (Online), Biosciences InformationService, Philadelphia, PA, US (Nov. 2013), Database accession No. PREV201400361750; Blood (Nov. 2013), 122 (21), 2767.
Yang, H. et al.: Expression of PD-L1, PD-L2, PD-1 and CTLA4 in myelodysplastic syndromes is enhanced bytreatment with hypomethylating agents. Leukemia (Nov. 25, 2013), ISSN: 0887-6924, DOI: 10.1038/leu.2013.355.
Zerbino, D. R. et al.: The Ensembl Regulatory Build. Genome Biol., vol. 20, 2015, p. 56.
Zou, W. et al.: PD-L1 (B7-H1) and PD-1 pathway blockade for cancer therapy: Mechanisms, responsebiomarkers, and combinations. Science Translational Medicine (Mar. 2, 2016), 8 (328), 328rv4.
Basu et al Clinical Epigenetics. published online Feb. 3, 2017. 9(13): p. 1-15 and Supplemental Table S4, 4 pages (Year: 2017).
Fietz et al Cancer Immunology, Immunotherapy (2021) 70: 1781-1788 (Year: 2021).
Goltz et al Leukemia. Available online Nov. 14, 2016. 31 :738-743 and Supplementary tables 1 and 2 (Year: 2016).
Goltz et al. JCI Insight. Jul. 12, 2018. 3(13): p. 1-10. (Year: 2018).
Hannani et al Cell Research. 2015. 25: 208-224 (Year: 2015).
Hodi et al Nejm. 2010. 363:711-723) (Year: 2010).
Khalil et al Cancer Network. Jan. 15, 2016, available via URL: < cancernetwork.com/view/modern-immunotherapy-treatment-advanced-gastrointestinal-cancers> (Year: 2016).
Kordi-Tamandani et al J Gastrointestin Liver Dis. Sep. 2014. 23(3): 249-253 (Year: 2014).
Lauss et al. J Invest Dermatology. Apr. 2015. 135: 1820-1828, available via URL: < sciencedirect.com/science/article/pii/S0022202X15373231 ?via%3Dihub>} (Year: 2015).

* cited by examiner

METHOD FOR ASSESSING A PROGNOSIS AND PREDICTING A RESPONSE OF PATIENTS WITH MALIGNANT DISEASES TO IMMUNOTHERAPY

CROSS-REFERENCE TO RELATED APPLICATIONS

This patent application is a continuation of U.S. Ser. No. 16/098,758, filed Nov. 15, 2018, as a § 371 national stage entry of PCT Application No. PCT/EP2017/061612, filed May 15, 2017, which claims priority of German Patent Application No. DE 10 2016 005 947.8, filed May 16, 2016, the disclosure of which is hereby incorporated by reference.

SEQUENCE LISTING

This application includes an electronic sequence listing in txt-format according to WIPO ST.25 standard with 485 sequences as part of the description, the contents of which are hereby incorporated by reference in their entirety.

FIELD OF THE INVENTION

This invention relates to molecular diagnostic methods in the field of oncology which can be used to assess the prognosis of a patient with a malignant disease or to predict the response of a patient with a malignant disease to immunotherapy. This invention also relates to molecular diagnostic methods which allow for an individualized selection of a suitable pharmaceutical compound for the immunotherapeutic treatment of these patients. Accordingly, this invention also relates to the use of such methods for determining prognosis, prediction of response or individualized selection of pharmaceutical compounds as well as prognostic and/or predictive biomarkers or biomarkers for individualized selection of pharmaceutical compounds.

Furthermore, this invention relates to kits for carrying out the specified methods or for the specified uses. In particular, the invention concerns in vitro methods and uses.

BACKGROUND OF THE INVENTION

The correct choice of treatment for a patient is a key concern in modern medicine. Choosing the right treatment requires, on the one hand, a precise assessment of the most probable course of the patient's disease, independent of a potential therapy. On the basis of this prognosis, the clinician can decide whether, for example, a rather conservative treatment should be applied if the course of the disease is likely to be favorable, or a more radical treatment if the course of the disease is likely to be unfavorable. A reliable estimation of the course of the disease would therefore allow to optimise the therapy. In particular, patients could benefit from a more targeted therapy.

The prognosis of a patient with a malignant disease (cancer) can currently only be assessed insufficiently. Usually, the prognosis of the patient is estimated on the basis of the degree of progression of the malignant disease. To this end, parameters such as the presence of metastases, the size of the tumor and infiltration into lymphatic and blood vessels are taken into consideration. Such methods for determining the tumor stage are different for each tumor entity. For a few tumors, there are other prognostic factors such as the Gleason growth pattern in patients with prostate cancer. Overall, the determination of the prognosis of patients with malignant diseases is insufficiently reliable and can hardly be standardized.

Prognostic biomarkers do have the potential to solve this problem. It is known from US 2014/0011702 A1 that methylation analysis of the DGKI, MGMT and SDPR genes can be used for prognosis or prediction in glioblastoma patients. US 2006/0121467 A1 describes a method that assesses the methylation of genes STMN1, SFN, S100A2, TGFBR2, TP53, PTGS2, FGFR1, SYK, PITX2, GRIN2D, PSA, CGA, CYP2D6, MSMB, COX7A2L, VTN, PRKCD, ONECUT2, WBP11, DAG1, ERBB2, TFF1, TMEFF2, ESR1, RASSF1, PITX2, PSAT1 and PCAF for the prediction of response to hormone therapy in breast cancer. It is known from US 2015/0051084 A1 that methylation of the HSPB1 gene is used to determine the prognosis of prostate cancer patients. In WO 2011/051414 A1, assessment of methylation of genes CLK3, MTMR4, NFE2L1, PERLD1, AKAP2, ANAPC1, ANKRD47, ATF7, ATP5G1, BCL2, C9orf3, COIL, CSF2, DMP1, E2F3, ELMO2, ERBB2, GABRG2, GPC5, HSPA6, KISS1, MARCH3, KIAA0100, MRO, MSX1, NCOA6, PAPOLA, PDGFRA, RPL23A, RUFY3, SOX3, TP53, TSPYL1, UBXD3 and ZNF420 for prognosis and prediction of response to platinum therapy in ovarian cancer patients is described.

On the other hand, a reliable prediction of a patient's response to immunotherapy is of high clinical and economic interest. A breakthrough in oncology is currently being achieved by immunotherapies with so-called immune checkpoint inhibitors, which show outstanding results even in advanced tumors. However, only a relatively small proportion of patients respond to such therapies. A predictive biomarker that could predict the response to these therapies would therefore be of particular clinical value. Currently, immunohistological methods with antibodies are being piloted, which are supposed to indicate the presence of the corresponding immune checkpoint proteins by means of a tissue section in order to predict the response to therapy. However, these tests show only moderate reliability.

In many cases, the therapy of patients with malignant diseases is still not chosen optimally, because the course of the disease in individual patients can often only be estimated inaccurately and the clinician therefore has insufficient information for an individual selection or adaptation of a therapy. There is therefore a lack of robust and economical prognostic and predictive methods based on objectively measurable parameters that allow for an accurate estimation of the course of the disease and a reliable prediction of the response to a therapy for patients with different malignant diseases.

SUMMARY OF THE INVENTION

Against this background, the present invention provides, in a first aspect, a method for assessing the prognosis of a patient with a malignant disease and/or for predicting the response of a patient with a malignant disease to immunotherapy. The method is characterized in that a DNA methylation analysis of at least one immunoregulatory gene of cells of the malignant disease and/or of T lymphocytes interacting with said cells of the malignant disease is performed and, on the basis of the result, the prognosis is determined and/or the response to the immunotherapy is predicted (prediction).

According to a second aspect, the invention provides a method for the individualized selection of a pharmaceutical compound for immunotherapeutic treatment of a patient with a malignant disease, in which a DNA methylation analysis of at least one immunoregulatory gene of cells of the malignant disease and/or of T lymphocytes interacting with said cells of the malignant disease is carried out and the pharmaceutical compound is selected on the basis of the result.

A third aspect of the invention relates to the use of DNA methylation analysis of at least one immunoregulatory gene of cells of a malignant disease of a patient and/or of T lymphocytes interacting with said cells of the malignant disease for determination of prognosis, prediction of response and/or individualized selection of a pharmaceutical compound for immunotherapeutic treatment of the patient.

A fourth aspect of the invention relates to the use of presence, absence or level of methylation of at least one CpG dinucleotide of an immunoregulatory gene of cells of a malignant disease and/or of T lymphocytes interacting with said cells of the malignant disease as prognostic and/or predictive biomarker or as biomarker for individualized selection of a pharmaceutical compound for immunotherapeutic treatment of the patient.

Finally, in a fifth aspect, the invention provides a kit for carrying out the methods or for the uses of the aforementioned aspects. The kit contains at least one oligonucleotide pair for DNA methylation analysis, said oligonucleotide pair being designed to hybridize to a sequence of the immunoregulatory gene in DNA from the cells of the malignant disease and/or from the T lymphocytes after cytosines contained in the DNA have been converted into uracil or another base having a base pairing behaviour and/or molecular weight distinguishable from that of cytosine in order to amplify and/or detect said sequence.

In all aspects of the invention, the immunoregulatory gene encodes an immune checkpoint selected from a group comprising B7 proteins and their receptors, MHC:peptide complex binding co-receptors, the members of the tumor necrosis factor receptor superfamily TNFRSF9, CD40, TNFRSF4, TNFRSF18 and CD27, the members of the immunoglobulin superfamily TIGIT, BTLA, HAVCR2, BTNL2 and CD48, and the adenosine-binding protein adenosine 2A receptor. Any combination of immunoregulatory genes encoding these immune checkpoints is also possible.

Preferred variants of these aspects can be derived from the description and the dependent claims.

Definitions and General Explanations

In this description, various documents are cited in order to provide a general technical background with respect to the present invention. The disclosure and teaching of these documents are hereby incorporated by reference in their entirety as a complement to the following description in order to avoid repetitions.

The following definitions and general explanations are intended to guide and support the skilled reader in understanding, interpreting and practicing the present invention. Unless indicated otherwise, all technical and scientific terms shall have the meaning which corresponds to the usual understanding of one of ordinary skill in the art in the field of the present invention.

The various aspects and variants of the invention involve techniques and methods that are routinely practiced in molecular biology. In particular, DNA methylation analysis for determining methylation of a CpG dinucleotide is part of the knowledge of a molecular biologist or geneticist. Useful laboratory manuals for these techniques and methods are readily available for the skilled person, such as "Molecular Cloning, A Laboratory Manual" by M. R. Green and J. Sambrook, 4th Edition, 2012, Cold Spring Harbor Laboratory Press.

As used herein, indefinite articles such as "a" or "an" include the possibility that two or more of these features may also be present.

As used herein, the term "malignant disease" or "malignancy" includes those diseases that are characterized by a disease progression that is progressively destructive and may also lead to the death of the patient. Malignant diseases include malignant formation of new tissue, such as neoplasms or tumors, wherein malignancy may be characterized by uncontrolled, space-consuming, displacing, infiltrative and/or invasive growth. Malignant tumors are usually able to form secondary tumors (metastases). Malignant tumors include for example carcinomas, sarcomas, melanomas, gliomas, blastomas, seminomas and teratomas. Malignant diseases also include haematological malignancies, i.e. malignant diseases affecting the blood system or the haematopoietic system, such as leukaemias, lymphomas, myeloproliferative disorders and myelodysplastic syndromes. Leukemias include a group of malignant diseases in which immature hematopoietic cells have changed malignantly, proliferate excessively and lead to an accumulation of cells in the peripheral blood. Lymphomas comprise diseases in which cells of the lymphatic system are malignantly degenerated. Myeloproliferative disorders comprise a group of diseases in which one or more haematopoietic cell lines proliferate excessively. Myelodysplastic syndromes comprise a clonal expansion of progenitor cells of all haematopoietic cell lines, which is based on a chronic differentiation disorder of the haematopoietic stem cells.

As used herein, the term "prognosis" means a conclusion about the condition of a patient with a malignant disease or the change in the patient's condition in the future. This can include both the condition of patients in the absence of a therapeutic intervention and the condition of patients who are already receiving or have received therapy. Prognosis in the sense of the present invention also encompasses the conclusion about the condition or the change of the condition, if the patient receives a therapy in the future. The therapy can be palliative, curative, neoadjuvant or adjuvant. In particular, "prognosis" comprises conclusion about the occurrence of one or more of the various conditions: death, survival, recurrence, occurrence of lymph node metastases, occurrence of distant metastases, progression of the malignant disease, regression of the malignant disease, no change in the malignant disease, increase or decrease of a parameter specific for the malignant disease.

The term "prediction" as used herein refers to a prediction of the response of a malignant disease to a particular therapy. The response to a therapy can be characterized by the fact that the degree of the malignant disease is decreasing, constant, or decelerated increasing when the therapy is applied. The absence of response can be characterized by the fact that the degree of the malignant disease is constant, increasing, or accelerated increasing. As a comparison, the degree of the malignant disease before application of the therapy or a patient who does not receive the therapy can be used. The degree of the disease can be characterized by the number of malignant cells or the size of the malignant tumor. In particular, a response to therapy may be characterized by a delay of death, recurrence, occurrence of lymph node metastases, occurrence of distant metastases, progression of the malignant disease, and/or increase in any other parameter specific for the malignant disease.

In particular, prognosis and prediction designate deductive steps in connection with a preceding in vitro procedure, so that no essential technical step of the invention takes place on the human or animal body.

A "gene" is a section of DNA that comprises regulatory, transcribed and/or functional sequence regions and thus contains the basic information for the production of biologically active RNA. In particular, a gene includes those elements, such as a promoter, transcription factor binding sites, CpG islands, open chromatin, enhancer and silencer, CTCF binding sites, which fulfill a regulatory function in the transcription of the gene.

The nomenclature for the designation of genes and their nucleotides is based on the recommendation of the Human Genome Organisation Gene Nomenclature Committee (HGNC) as of Apr. 30, 2016. A gene stem, for example, is designated with italic Latin capital letters (e.g. PDCD1, CD274).

The genes described here are publicly available via the "GenBank" of the National Institute of Health, USA, as of Apr. 30, 2016 (Benson D. A. et al., Nucleic Acids Research, 2013, 41, D36-42).

When reference is made in the following description to certain DNA sequences (SEQ ID NOs), this always includes sequence variants with at least 95%, at least 96%, at least 97%, at least 98% or at least 99% sequence identity with said DNA sequence. The sequence identity of two nucleic acid sequences can, for example, be determined using the ClustalW algorithm (Thompson et al., Nucleic Acids Research, 1994, 22, 4673-4680).

A "CpG dinucleotide" is a DNA motif which has the nucleoside sequence cytidine-phosphate-guanosine in the general reading direction from 5' to 3'. Guanosine consists of the nucleobase guanine and the sugar β-D-ribose. Cytidine consists of the nucleobase cytosine and the sugar β-D-ribose.

"DNA methylation" refers to the biochemical or chemical coupling of methyl groups to certain nucleotides of DNA. In the context of this invention, DNA methylation refers to the presence of a methyl group on the fifth carbon atom of a cytosine (5-methylcytosine) located within a CpG dinucleotide context.

"DNA methylation analysis" in the sense of the present invention therefore comprises the determination of the methylation state of one or more CpG dinucleotides from a particular sequence context. In various variants of the invention, "DNA methylation analysis" means the determination of whether the cytosine in the CpG dinucleotide(s) is methylated. The DNA methylation analysis may include a single copy of the CpG dinucleotide. The DNA methylation analysis may also include a large number of copies of the CpG dinucleotide, for example if the DNA of a large number of cells is present. In this case, the DNA methylation analysis may provide a methylation level or methylation value of the CpG dinucleotide, i.e. an average value expressing the level of methylation in the plurality of copies of the CpG dinucleotide.

An "immune checkpoint" is a protein that modulates the immune response, i.e. is either immunosuppressive and anti-inflammatory (inhibits inflammation), or immunostimulatory and pro-inflammatory (promotes inflammation). Immune checkpoints serve to monitor the correct function of the immune response by, for example, co-stimulating (positively regulating) or co-inhibiting (negatively regulating) the strength and intensity of antigen-specific T cell activation or T cell effector function. In some malignant diseases, for example, anti-inflammatory or co-inhibitory immune checkpoints are upregulated during immune evasion.

In the sense of the present invention, "T lymphocytes interacting with the cells of the malignant disease" includes those T lymphocytes that are in specific contact with cells of the malignant disease via a ligand-receptor binding or are capable of being in specific contact with them. The ligand can be located on the surface of cells of the malignant disease, for example an MHC:peptide complex or an MHC II:antigen complex. The receptor can be located on the surface of the T lymphocytes, for example a T cell receptor (TCR). Alternatively, the ligand can be located on the surface of T lymphocytes and the receptor on the surface of malignant cells. "T lymphocytes interacting with the cells of the malignant disease" therefore also comprises T lymphocytes that have been activated by contact with antigen-presenting cells so that they are able to interact specifically with cells of the malignant disease via one of the aforementioned ligand-receptor interactions without having previously come into contact with the original antigen by themselves. An antigen-presenting cell can, for example, be a dendritic cell or a macrophage. Said activation can take place, for example, via a ligand-receptor interaction between T lymphocytes and an antigen-presenting cell which presents an antigen originating from a cell of the malignant disease. The ligand, for example an MHC II:antigen complex, is located on the surface of the antigen-presenting cells and the T cell receptor (TCR) is located on the surface of the T lymphocyte. Another form of interaction between T lymphocytes and cells of the malignant disease in the sense of the invention comprises adenosine produced by cells of the malignant disease being bound by a receptor on the surface of T lymphocytes. It is also possible that the adenosine is produced by T lymphocytes and the receptor is located on the surface of malignant cells.

"Immunotherapy" or "immunotherapeutic treatment" is used herein as a collective term for all methods of treatment aimed at influencing the activity of the immune system. Immunotherapy can be aimed at strengthening or weakening the effect of the immune system. In certain variants of the invention, immunotherapy involves treatment with pharmaceutical compounds to enhance the organism's own immune response to malignant disease. Such pharmaceutical compounds include immune checkpoint inhibitors such as monoclonal antibodies that specifically bind to immune checkpoints and thereby prevent their (in particular anti-inflammatory) signalling. Another possibility is to use pharmaceutical compounds that already inhibit the expression of immune checkpoints, for example by RNA interference or CRISPR interference. The pharmaceutical compounds can also be immune checkpoint agonists, which increase the signaling of (in particular pro-inflammatory) immune checkpoints.

As the term is used herein, "inhibiting" an immune checkpoint means slowing down, inhibiting or preventing one or more reactions of a chemical, biological and/or physical nature mediated by the immune checkpoint.

"Biomarkers" are characteristic indicators or/and biological features that can be objectively measured and allow for conclusions to be drawn about the status of a normal biological or pathological process in an organism, or the response of a normal or pathological process to an intervention, such as surgery, radiation or medical treatment. Biomarkers are often (bio)chemical substances, such as proteins, hormones, metabolites, sugars and nucleic acids, and modifications thereof.

A "palliative therapy" is a medical treatment that does not aim at healing a disease, but at alleviating the symptoms or reducing other negative outcomes (palliation). They are thus in contrast to curative therapies, which aim at healing. The measures of palliative medicine often have the aim of slowing down the course of progressive incurable diseases and reducing symptoms such as nausea, pain or (reactive) depression.

A "curative therapy" is a therapy which aims at a complete restoration of a patient's health and in this way at the same time prevents a worsening of the condition. The term is also used in particular when a complete cure is not foreseeable (low percentage chance).

A "neoadjuvant therapy" is a therapy that is applied to reduce the tumor mass before a planned surgical intervention. It is often applied when a tumor is not primarily operable. With neoadjuvant therapy, the tumor can be reduced in size with the result that surgical removal of the tumor is eventually possible. In this case, it is often the only way of curative therapy of a malignant tumor.

The term "adjuvant therapy" is used to describe a complementary or auxiliary therapeutic measure that is applied after complete removal of all detectable tumor parts in order to combat any potential but as yet undetectable tumor metastases (micro metastases) and thus improves the long-term healing prospects.

Both the general description above as well as the following detailed description are to be understood as examples and are intended to explain the claimed invention. Further advantages and features of the invention are apparent from the following description, drawings and claims. While the invention is described on the basis of preferred embodiments, many further variations can be made without departing from the scope of the present invention. Therefore, it is intended that the claims cover variations and combinations of features that are included in the actual scope of the invention, even if they are not expressly mentioned in the claims.

Figure 1:
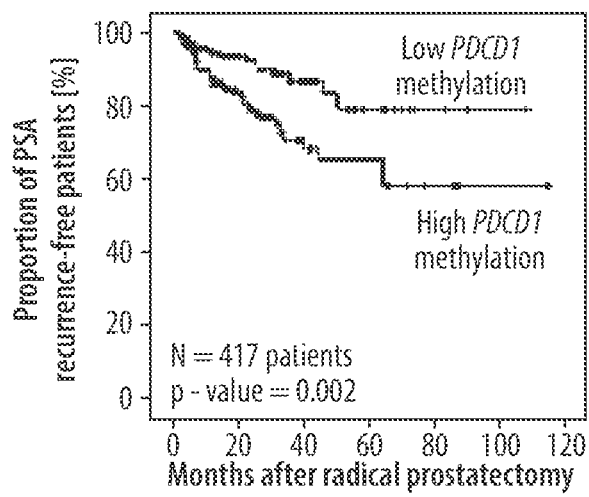
FIG. 1 shows the Kaplan-Meier analysis of relapse-free survival of 417 prostate cancer patients after radical prostatectomy. Patients are stratified by DNA methylation analysis of the PDCD1 gene locus in the tumor.

(E, F, G) and CD40 (H, I, J). Group I and IV: DNA methylation below threshold; Group II and III: DNA methylation above threshold; Group V: Group II and IV patients; Group VI: Group II and III patients or I and IV patients; Group VII: Group I and III patients.

FIG. 11 shows the Kaplan-Meier analysis of overall survival of 182 patients with acute myeloid leukaemia, using DNA methylation analysis (A, D, G), mRNA expression analysis (B, E, H) and the combination of mRNA expression analysis and DNA methylation analysis (C, F, I) of the immunoregulatory genes CD274 (A, B, C), PDCD1 (D, E, F) and PDCD1LG2 (G, H, I) according to the present invention. Group I: DNA methylation below threshold; Group II: DNA methylation above threshold; Group III: mRNA expression above threshold; Group IV: mRNA expression below threshold. Thresholds: 17.00% for CD274 DNA methylation; 56.95% for PDCD1 DNA methylation; 62.82% for PDCD1LG2 DNA methylation; 4.7319 for CD274 mRNA expression; 23.7933 for PDCD1 mRNA expression and 12.9895 for PDCD1LG2 mRNA expression.

FIG. 12 shows the Kaplan-Meier analysis of overall survival of 182 patients with acute myeloid leukaemia, wherein patients were stratified according to the present invention by DNA methylation analysis of the immunoregulatory genes TNFRSF9 (A), TIGIT (B), BTLA (C), HAVCR2 (D), CD80 (E), CTLA4 (F), ICOS (G), C10orf54 (H), HHLA2 (I), CD160 (J), KIR2DL4 (K) and KIR3DL1 (L). The dichotomization was carried out on the basis of optimized threshold values. Group I: DNA methylation below threshold; Group II: DNA methylation above threshold.

FIG. 13 shows the Kaplan-Meier analysis of overall survival of 510 patients with low-grade gliomas stratified according to the present invention by DNA methylation analysis (A, D, G), mRNA expression analysis (B, E, H) and the combination of DNA methylation analysis and mRNA expression analysis (C, F, I) of the immunoregulatory genes CD274 (A, B, C), PDCD1 (D, E, F) and PDCD1LG2 (G, H, I). The following thresholds were used for the dichotomization of DNA methylation: 32.00% for CD274; 33.79% for PDCD1 and 59.89% for PDCD1LG2. Dichotomization of mRNA expression was performed using the median mRNA expression of the respective gene from all tumors of the patient group. Group I: DNA methylation below the threshold; Group II: DNA methylation above the threshold; Group III: mRNA expression above the median; Group IV: mRNA expression below the median; Group I+III: patients from groups I and III; Group II+IV: patients from groups II and IV; Group I+IV/II+III: patients from groups II and III or I and IV.

FIG. 14 shows the Kaplan-Meier analysis of overall survival of 510 patients with low-grade gliomas stratified according to the present invention by DNA methylation analysis (A, D, G, J), mRNA expression analysis (B, E, H, K) and combined DNA methylation analysis and mRNA expression analysis (C, F, I, L) of the immunoregulatory genes CD80 (A, B, C), CTLA4 (D, E, F), ICOS (G, H, I) and CD276 (J, K, L). For the dichotomization based on DNA methylation, the following threshold values were selected: 90.76% (CD80); 86.43% (CTLA4); 84.75% (ICOS); and 30.08% (CD276). Dichotomization of mRNA expression was performed using the median mRNA expression of the respective gene from all tumors of the patient group. Group I: DNA methylation below the threshold; Group II: DNA methylation above the threshold; Group III: mRNA expression above the median; Group IV: mRNA expression below the median; Group I+III: patients from groups I and III; Group II+IV: patients from groups II and IV; Group I+IV/II+III: patients from groups II and III or I and IV.

FIG. 15 shows the Kaplan-Meier analysis of overall survival of 510 patients with low-grade gliomas stratified according to the present invention by DNA methylation analysis of the genes TNFRSF25 (A), TNFRSF9 (B), CD40 (C), TIGIT (D), BTLA (E), HAVCR2 (F), C10orf54 (G), HHLA2 (H), LAG3 (I), CD160 (J), KIR2DL4 (K), and KIR3DL1 (L). Dichotomization was performed using the following thresholds: 61.88% for TNFRSF25; 79.24% for TNFRSF9; 43.24% for CD40; 80.66% for TIGIT; 84.64% for BTLA; 2.495% for HAVCR2; 66.52% for C10orf54; 77.14% for HHLA2; 74.34% for LAG3; 92.89% for CD160; 90.85% for KIR2DL4 and 52.28% for KIR3DL1. Group I: methylation below threshold; Group II: methylation above threshold.

FIG. 16 shows the Kaplan-Meier analysis of overall survival of 318 patients with clear cell renal cell carcinomas, stratified according to the present invention by DNA methylation analysis of the immunoregulatory genes TIGIT (A), TNFRSF9 (B), CD274 (C), CD80 (D), CTLA4 (E), CD276 (F) and HHLA2 (G). Dichotomization was performed using the median of DNA methylation of the respective gene from the tumors of all patients. Group I: methylation below the median; Group II: methylation above the median.

FIG. 17 shows the Kaplan-Meier analysis of overall survival of 318 patients with clear cell renal cell carcinomas stratified according to the present invention by combination of DNA methylation analysis and mRNA expression analysis of the immunoregulatory genes TIGIT (A), TNFRSF9 (B), CD80 (C), CTLA4 (D), CD276 (E) and HHLA2 (F). Dichotomization was performed on the basis of the median of DNA methylation or mRNA expression of the respective gene from the tumors of all patients. Group I: DNA methylation below and mRNA expression above the median; Group III: DNA methylation above and mRNA expression below the median; Group II: DNA methylation above and mRNA expression above the median or DNA methylation below and mRNA expression below the median.

Figure 18:
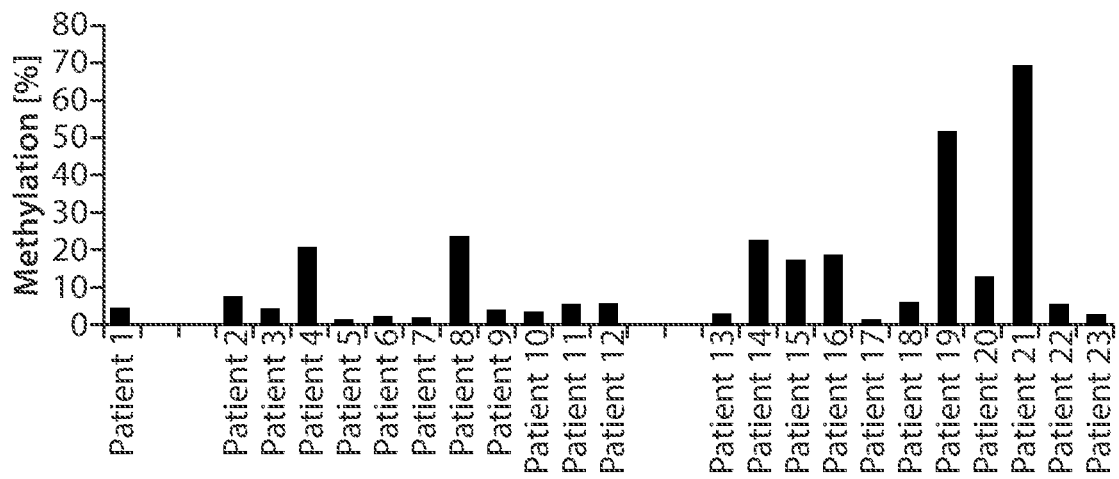

FIG. 18 shows the DNA methylation analysis according to the present invention of the immunoregulatory gene CD274 to determine the response of patients to immunotherapy with the pharmaceutical compound pembrolizumab, which inhibits the immunoregulatory effect of the immune checkpoint encoded by the gene PDCD1. The methylation values (%) of the gene in metastases of 23 patients with malignant melanomas that were surgically removed prior to immunotherapy are shown.

Figure 19:
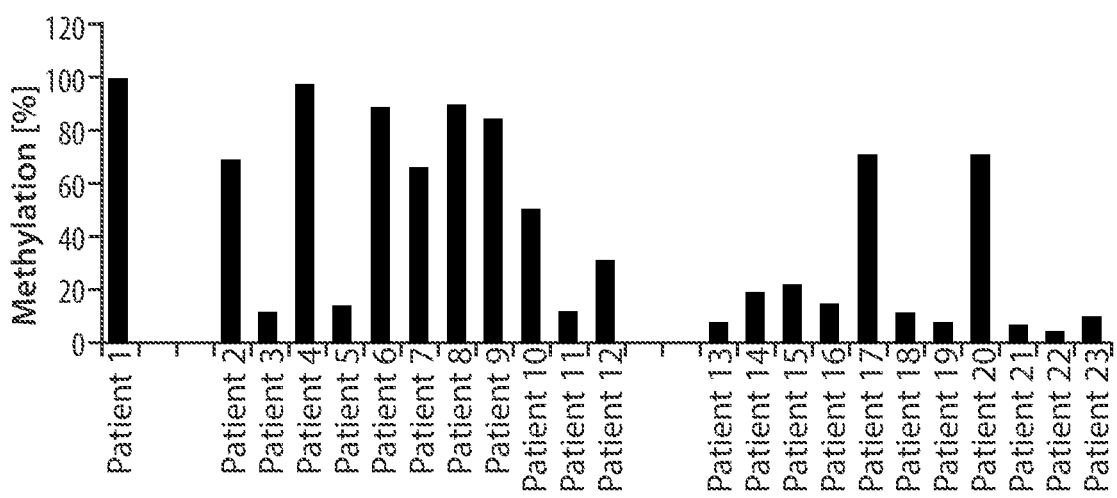

FIG. 19 shows the DNA methylation analysis of the immunoregulatory gene PDCD1 according to the present invention for determining the response of patients to immunotherapy with the pharmaceutical compound pembrolizumab, which inhibits the immunoregulatory effect of the immune checkpoint encoded by the gene PDCD1. The methylation values (%) of the gene in metastases of 23 patients with malignant melanoma that were surgically removed prior to immunotherapy are shown.

BRIEF DESCRIPTION OF THE SEQUENCES

SEQ ID NO:1 to SEQ ID NO:485 as indicated in each case under the numeric identifier <213> or <223> of the sequence listing.

DESCRIPTION OF THE INVENTION

The first aspect of the present invention relates to a method for assessing a prognosis of a patient with a malignant disease and/or for predicting the response of a patient with a malignant disease to immunotherapy. Herein, a DNA methylation analysis of at least one immunoregulatory gene of cells of the malignant disease and/or of T lymphocytes interacting with said cells of the malignant disease is performed. The immunoregulatory gene encodes an immune checkpoint selected from B7 proteins and their receptors, i.e. receptors which bind a B7 protein as ligand, MHC:peptide complex binding co-receptors, the members of the tumor necrosis factor receptor superfamily TNFRSF9, CD40, TNFRSF4, TNFRSF18 and CD27, the members of the immunoglobulin superfamily TIGIT, BTLA, HAVCR2, BTNL2 and CD48 as well as the adenosine-binding adenosine 2A receptor. It is also possible to perform DNA methylation analyses of multiple immunoregulatory genes, which may include any combination of said immune checkpoints. In this case, DNA methylation analyses of several immunoregulatory genes involved in the same ligand-receptor interaction are preferably performed. Based on the result of the DNA methylation analysis, the prognosis is then determined and/or the response to the immunotherapy is then predicted (prediction).

This invention was the result of the understanding that malignant diseases involve complex genetic and epigenetic changes and can therefore be manifested very individually. Even malignant diseases of the same organ and in the same disease stage can therefore lead to a different prognosis of the patient. In the course of his research, the present inventor recognized that there are immunological subtypes of malignant diseases that are either better or worse controlled by the body's immune system, resulting in a more favorable or less favorable course of the disease. This property could be attributed to the fact that these subtypes have distinct signatures of DNA methylation and mRNA expression of immunoregulatory genes.

According to the research of the inventor, the cells of malignant diseases or the T lymphocytes interacting with the cells of malignant diseases or both cell types in patients with a favorable course of disease are, inter alia, characterized by distinctive expression of one or more B7 proteins and their receptors, one or more MHC:peptide complex binding co-receptors, one or more of TNFRSF9, CD40, TNFRSF4, TNFRSF18 and CD27, one or more of TIGIT, BTLA, HAVCR2, BTNL2, CD48 and/or the adenosine-binding adenosine 2A receptor. In this context, the inventor was able to demonstrate for the first time that the expression of these immunoregulatory genes is regulated by methylation. In this way, DNA methylation analysis can be used to describe an immunological phenotype which is defined and objectively measurable by the methylation of the immunoregulatory genes.

In the course of this invention it was found that the methylation of the immunoregulatory genes of the present invention correlated significantly with the prognosis of the patient's malignant disease. An important and very surprising finding of the inventor is that this is a general phenomenon of malignant diseases which is not limited to certain entities. Thus, this invention provides for the first time prognostic tests which, on the basis of a DNA methylation analysis of the same genes, are universally suitable for prognosticating the course of disease of a multitude of different malignant disease types, whereas methylation analyses of the genes previously known as biomarkers only allowed a prognosis with respect to individual or a few entities. In this regard, reference is also made to the following examples.

Another unique feature and particular advantage of the invention is that the immunoregulatory genes identified by the inventor, the DNA methylation of which is prognostic for the course of a malignant disease, also encode immune checkpoints, which are key targets of immunotherapies. Knowledge of the degree of presence or absence of the corresponding gene products is therefore highly relevant for the planning of effective immunotherapeutic treatment. Since it could be shown that the DNA methylation of the immunoregulatory genes is directly correlated with the expression of the corresponding immune checkpoints, the method according to the present invention allows for, alternatively or in addition to the estimation of the prognosis, a prediction of the patient's response to a corresponding immunotherapy. For example, the response is likely if the DNA methylation analysis indicates an expression of the immune checkpoint. Thus, for the first time, a simultaneous determination of the patient's prognosis and prediction of the response to an immunotherapy can be performed within the same test, whereas common methods based on conventional marker genes so far allowed for either only prognosis or only prediction.

The DNA methylation analysis can basically be performed with all common methods known to the person skilled in the art from the relevant literature. A suitable method includes the following steps, for example: A) providing DNA of the malignant cells or the T lymphocytes; B) converting at least part of the cytosines contained in the DNA into uracil or another base having a base pairing behaviour and/or molecular weight distinguishable from that of cytosine; C) analyzing the DNA methylation of the immunoregulatory gene within the DNA obtained from step B).

The DNA to be analysed in step A) can originate from different sources, for example from cells of the malignant disease or infiltrating T lymphocytes from surgically or bioptically removed tissue. The cells can also originate from smears and aspirates such as rinsing fluids, fine needle aspirates or sputum. The DNA can also originate from blood, blood serum and blood plasma, for example in the form of circulating cell-free DNA, exosomal DNA, or in the form of circulating cells from which DNA is obtained. The DNA can also originate from other body fluids such as urine, pleural effusions or ascites, for example in the form of free DNA or in the form of cells from which the DNA is obtained. The DNA can also be obtained from non-preserved (fresh) cells, tissues and bodily fluids, as well as from fixed cells, tissues and bodily fluids. Fixation of cells, tissues and bodily fluids can be achieved by precipitating fixatives such as ethanol and other alcohols or by cross-linking fixatives such as formaldehyde. The DNA can also be derived from any combination of these sources. It can also be extracted DNA from the aforementioned sources. It is also possible to enrich the DNA, for example by precipitation or extraction. This can be advantageous, for example, in the case of circulating cell-free DNA from the bodily fluids mentioned above. It is also possible to enrich the cells, for example by size filtration or via magnetic particles carrying antibodies on the surface whose antigens are located on the surface of the cells to be enriched. This can be expedient, for example, in the case of circulating cells of the malignant disease or T lymphocytes from these body fluids. Other suitable sources for the DNA to be analysed are homogenisates of fresh tissues and lysates of fixed tissues.

In a preferred variant, the DNA comprises circulating cell-free DNA, DNA from exosomes, and/or DNA from circulating cells from a bodily fluid, so-called "liquid biopsies". Liquid biopsies currently represent a central area of oncological research. Instead of analysing the suspicious tissue itself, e.g. a tumor tissue, a sample of a bodily fluid is analyzed, for example a blood sample. This sample can be used to examine different substances originating from the tumor, as circulating cell-free genomic DNA, exosomal DNA or circulating cells are released from the tumor into the bloodstream. The method of the present invention is advantageously used for the analysis of liquid biopsies if the tumor or a metastasis cannot be biopsied or if a biopsy would pose too great a risk to the patient in the late tumor stage. This invention is outstanding in that the DNA methylation of the immunoregulatory genes can be measured very well in bodily fluids, whereas a conventional determination of expression of the immunoregulatory genes on the basis of mRNA or immunohistochemistry is difficult or even impossible.

In principle, the conversion of the DNA in step B) can be carried out with all state-of-the-art methods known and suitable for this purpose. Typically, it is a chemical or enzymatic conversion, for example by contacting the DNA with bisulfite, for example sodium bisulfite or ammonium bisulfite.

If necessary, the DNA may be purified after conversion in step B) and before determining DNA methylation in step C). Suitable purification methods and protocols are known to the skilled person and may include DNA extraction, precipitation or polymer-mediated enrichment.

The DNA methylation analysis may include determining the presence, absence or level of methylation of at least one CpG dinucleotide contained in the immunoregulatory gene. It is also possible to analyze several CpG dinucleotides of the immunoregulatory gene. These dinucleotides can also be distributed over different parts of the immunoregulatory gene to be investigated. In preferred variants, the methylation of at least one CpG dinucleotide from each of at least two different immunoregulatory genes is determined. In this way, the invention solves the problem that CpG dinucleotides in the DNA of a malignant disease can sometimes be heterogeneously methylated. False-negative and false-positive measurement results are therefore avoided, so that a particularly reliable and, moreover, particularly differentiated prognosis and/or prediction is achieved, as is demonstrated in the following examples.

The determination of the DNA methylation of the immunoregulatory gene in step C) is not particularly limited. A person skilled in the art can easily determine suitable methods on the basis of this disclosure. In this regard, reference is also made to the laboratory manuals mentioned above. In a preferred variant, a polymerase chain reaction (PCR) with oligonucleotides, so-called primers, is first carried out, which is designed to amplify a portion of the converted DNA comprising at least one CpG dinucleotide to be analyzed. Subsequently, at least part of the amplificate is preferably sequenced, e.g. by Sanger sequencing, pyrosequencing, mass spectrometric sequencing or second or third generation sequencing, also known as Massive Parallel Sequencing, Next Generation Sequencing (NGS) or nanopore sequencing. It is also possible to maintain a hybridization with mutation-specific oligonucleotides (probes) after the PCR, for example in the form of a DNA microarray. Methylation can also be determined by quantitative real-time PCR (qPCR), optionally followed by a melting curve analysis. In particular, the quantitative real-time PCR can be performed with methylation-specific primers as described in WO 1997/046705 A1 and/or methylation-specific blocker oligonucleotides as described in WO 2002/072880 A2. In a preferred variant, methylation-specific detection probes are used.

In other preferred variants, PCR can be omitted, e.g. in whole genome shotgun bisulfite sequencing (WGSBS) or direct nanopore sequencing. In WGSBS, the DNA is fragmented before adapters are ligated to the DNA fragments. The adapters can then be used for amplification and sequencing. It is also possible to omit the step of fragmentation in WGSBS, as the DNA may already be fragmented, e.g. due to the conversion by bisulfite treatment. Protocols for performing a WGSBS are easily accessible to the skilled person (Johnson, M. D. et al., Curr. Protoc. Mol. Biol., 2012, 99, 21.23.1-21.23.28; Lister, R. et al., Nature, 2009, 462, 315-322; Berman, B. P. et al., Nat. Genet., 2011, 44, 40-46).

In another preferred variant, a hybridization with specific oligonucleotides (probes) can be performed prior to PCR amplification, wherein in the case of binding, these oligonucleotides are ligated and subsequently amplified by PCR. Suitable methods and protocols, such as "multiplex ligation dependent probe amplification" (MLPA), are easily available to the skilled person, for example from "PCR Mutation Detection Protocols" by B. D. M. Theophilus and R. Rapley, 2nd Edition, 2011, Springer.

In another preferred variant, the methylation analysis is performed using the Infinium Human Methylation450 BeadChip. Suitable protocols can be found for example in the chapter "Determination of DNA Methylation Levels Using Illumina HumanMethylation450 BeadChips" by M. A. Carless, which can be found in the book "Chromatin Protocols" by S. P. Chellappan, Volume 1288, 2015, of the book series "Methods in Molecular Biology", Springer Science+Business Media New York. Further suitable protocols can be derived from the following examples.

The DNA methylation analysis is preferably carried out under conditions allowing for a quantitative determination of the methylation of the at least one CpG dinucleotide. The quantitative determination may also include the methylation state of several CpG dinucleotides in one or more genes. The quantities obtained can then be averaged, for example to obtain a particularly robust value. In this way, a particularly high robustness and precision of the method is achieved. A quantitative methylation analysis, for example, is useful for determining a relative methylation by correlating the number of methylated copies of a gene locus to the total number of copies of the same gene locus.

The result of the DNA methylation analysis or the methylation of the immunoregulatory gene can then be compared with a reference value, for example, to determine the prognosis and/or the likelihood of response of the patient to immunotherapy. The determination of suitable reference values is routine in medical laboratory practice. One possibility is to perform a DNA methylation analysis of the immunoregulatory gene in a group of patients with a comparable malignant disease, in particular of the same entity, whose prognosis and/or response to immunotherapy is already known from a retrospective analysis. On this basis, the DNA methylation of the immunoregulatory gene can then be correlated with the prognosis and/or the probable response to immunotherapy. For example, the retrospectively analysed group is divided into two or more subgroups whose prognosis or response can be distinguished by the DNA methylation of the immunoregulatory gene. A suitable reference value is then, for example, a value of DNA methylation which separates two subgroups from each other, hereinafter also referred to as a threshold value. Depending on whether the result of the DNA methylation analysis is above or below the threshold value, an individual patient can be assigned to one of the groups with a known prognosis or therapy response.

It is also possible to correlate the result of the DNA methylation analysis with an mRNA expression of the immunoregulatory gene. If, for example, the expression of said gene is an indicator for the prognosis of the patient, then the prognosis of the patient can be determined by determining the mRNA expression by means of the DNA methylation of this gene. Since the expression of the immunoregulatory genes of the present invention also provides the target for immunotherapeutic treatment, the response to a corresponding immunotherapy that utilizes the immune checkpoint encoded by the immunoregulatory gene as target can be accurately predicted in this way.

The present invention is particularly outstanding for the fact that the DNA methylation analysis of the immunoregulatory genes of the present invention is universally suitable for predicting the course of the disease or the response to immunotherapy in many different tumor entities in a way that was not expectable for a person skilled in the art. For instance, the malignant disease can include a carcinoma, a melanoma, a sarcoma, a glioma, a lymphoma and/or a leukaemia. Said carcinoma may include, for example, an adenocarcinoma, a squamous cell carcinoma, a small cell carcinoma, a neuroendocrine carcinoma, a renal cell carcinoma, an urothelial carcinoma, a hepatocellular carcinoma, an anal carcinoma, a bronchial carcinoma, an endometrial carcinoma, a cholangiocellular carcinoma, a hepatocellular carcinoma, a testicular carcinoma, a colorectal carcinoma, a carcinoma of the head and neck, a carcinoma of the esophagus, a gastric carcinoma, a breast carcinoma, a renal cell carcinoma, an ovarian carcinoma, a pancreatic carcinoma, a prostate carcinoma, a thyroid carcinoma and/or a cervical carcinoma. For example, a sarcoma may be an angiosarcoma, a chondrosarcoma, a Ewing sarcoma, a fibrosarcoma, a Kaposi sarcoma, a liposarcoma, a leiomyosarcoma, a malignant fibrous histiocytoma, a neurogenic sarcoma, an osteosarcoma or a rhabdomyosarcoma. For example, a leukemia can be acute a myeloid leukemia (AML), an acute lymphocytic leukemia (ALL), a chronic lymphocytic leukemia (CLL), or a chronic myeloid leukemia (CML). A lymphoma can be a Hodgkin's lymphoma or non-Hodgkin's lymphoma. A non-Hodgkin's lymphoma may be a B-cell lymphoma or a T-cell lymphoma. Corresponding support can be found in the examples.

In another variant of the method, in addition to the DNA methylation analysis, an mRNA expression analysis of the immunoregulatory gene is performed. This may include, for example, a determination of the mRNA expression level of at least one transcript variant of the immunoregulatory gene or of at least one transcript variant of each of at least two different immunoregulatory genes. Preferably, the mRNA expression analysis is also performed under conditions that allow for a quantitative determination of the mRNA expression level.

Suitable protocols for the mRNA expression analysis are well known to the skilled person and usually include the following steps: a) provision of mRNA from the cells of the malignant disease or the T lymphocytes, respectively; b) conversion of the mRNA into cDNA; c) determination of cDNA from the immunoregulatory gene. However, it is also possible to analyze the mRNA directly without prior transcription into cDNA. Nanostring technology is particularly suitable for this purpose. The mRNA expression analysis can also be performed using RNA-Seq (RNA sequencing) or whole transcriptome shotgun sequencing (WTSS). Herein, Next-generation sequencing (NGS) methods can be used to determine the presence and/or quantity of an mRNA. For example, a number of mRNA molecules of a given sequence can be determined and related to the number of all mRNA molecules to determine a normalized count, as also used in the following examples. Suitable RNA-Seq techniques and ready-to-use solutions are available from Illumina, San Diego, Calif., USA.

Surprisingly, the combination of DNA methylation analysis and mRNA expression analysis in accordance with the present invention leads to an additionally improved assessment of the prognosis in that an even more precise stratification of prognosis groups can be achieved. The combination of the analyses can be carried out in such a way that initially one prognosis group is determined for a patient on the basis of each the DNA methylation analysis and the mRNA expression analysis of an immunoregulatory gene, for example using the reference values described above. Subsequently, these prognosis groups can be consolidated so that further subgroups result for the prognosis. For example, a subgroup with a poor prognosis can be defined if both the mRNA expression analysis and the DNA methylation analysis of the immunoregulatory gene indicate a poor prognosis. A subgroup with a good prognosis can be defined, for example, if the patient has a good prognosis based on both the mRNA expression analysis and the DNA methylation analysis of the immunoregulatory gene. Two intermediate prognosis groups include, for example, those patients for whom either the DNA methylation analysis or the mRNA expression analysis of the immunoregulatory gene indicates a good prognosis, whereas the other analysis indicates a poor prognosis. An even more differentiated stratification is possible if several immunoregulatory genes are analyzed, which can be used to perform a multifactorial categorization into prognosis groups. On this basis, the present invention allows for for a clinical decision making that, in a previously unprecedented way, can be more accurately and reliably tailored to the individual patient using objectively measurable parameters.

The altered DNA methylation of cells of a malignant disease affects a large number of CpG dinucleotides within and in the environment of a gene. CpG dinucleotides in promoters and in the sequence encoding the transcript of the immunoregulatory gene in the cells of the malignant disease or the T lymphocytes are particularly suitable for performing the method of the invention. However, the methylation of CpG dinucleotides outside the gene body of the immunoregulatory genes in the cells of the malignant disease or the T lymphocytes may also be altered and suitable for the method of the present invention. Preferred areas for the DNA methylation analysis according to the present invention include regulatory gene regions, in particular transcription factor binding sites, promoters, CpG islands, silencers, enhancers, CTCF binding sites and combinations thereof. Enhancers may be present as distal enhancers remote from the gene. Enhancers can also be located near the gene and are then termed proximal enhancers. Regulatory gene areas are well known to the skilled person and are described, for example, in "Gene Control" by D. S. Latchman, 2nd Edition, 2015, Garyland Science, Taylor & Francis Group, LLC. For example, CpG dinucleotides whose methylation state correlates with the transcriptional activity or expression of a gene are also suitable for performing the method of the present invention. The transcriptional activity can be identified, for example, by an altered chromatin structure. So-called "open chromatin" can be associated with a high transcriptional activity of a gene, as described for example in "Genetics" by W. Janning and E. Kunst, 2004, Georg Thieme Verlag, Stuttgart and New York. Areas of "open chromatin" are therefore suitable for the DNA methylation analysis of the present invention.

The determination of regulatory gene elements is readily possible for the skilled person using suitable databases. For example, such regulatory elements are annotated in the database "Ensembl", as for instance in "The Ensembl Regulatory Build" by D. R. Zerbino, S. P. Wilder, N. Johnson, T. Juettemann and P. R. Flicek, 2015, Genome Biology, Issue 16, doi:10.1186/s13059-015-0621-5.

A suitable primary sequence of the human genome that can be used to determine suitable and preferred areas and sequences of immunoregulatory genes for the DNA methylation analysis of the present invention is, for example, the human genome version of the Genome Reference Consortium Human Build 38 (GRCh38) or Reference Consortium Human Build 38 patch release 7 (GRCh38.p7) as of Mar. 21, 2016. In the following, reference is made to regions of the genome according to the notation "chromosome number: position of the first base of the region-position of the last base of the region", e.g. "2:241849881-241858908" for the region from base 241849881 to base 241858908 of chromosome 2.

In a variant, the immunoregulatory gene is selected from the genes encoding B7 proteins and their receptor CD274, PDCD1LG2 and PDCD1. In another variant, the immunoregulatory gene is selected from the genes encoding the B7 protein and its receptor CD80 and CTLA4. In yet another variant, the immunoregulatory gene is selected from the gene encoding the receptor of a B7 protein ICOS and the genes encoding B7 proteins CD276, C10orf54 and HHLA2. In another variant, the immunoregulatory gene is selected from the genes encoding MHC:peptide complex binding co-receptors LAG3, CD160, KIR2DL4 and KIR3DL1. Any combination of the immunoregulatory genes from these variants is also possible.

The gene PDCD1 or programmed cell death 1 is also known under the synonyms CD279, PD1, hPD-1, SLEB2, PD-1, hSLE1 and hPD-1. PDCD1 is an immunoregulatory gene and encodes a protein which is an immune checkpoint in the sense of the present invention. The protein PDCD1 is a receptor and can, for example, bind the two ligands belonging to the B7 proteins encoded by the genes CD274 and PDCD1LG2. PDCD1 belongs to the immunoglobulin superfamily. Preferred areas for the DNA methylation analysis of PDCD1 are contained in areas encoding the transcripts (2:241849881-241858908, SEQ ID NO:17), regions with open chromatin (2:241849051-241853001, SEQ ID NO:18 and 2:241861820-241862593, SEQ ID NO:19), the enhancer (2:241852997-241855201, SEQ ID NO:2), a CTCF binding site (2:241859081-241860074, SEQ ID NO:3) and/or promoters (2:241856912-241861429, SEQ ID NO:29 and 2:241862929-241865230, SEQ ID NO:30). Other preferred areas for the DNA methylation analysis of PDCD1 are selected from those described for this purpose in examples 1, 3, 5, 7, 8, 10, 12 and 17. For the mRNA expression analysis of the present invention, the detection of at least part of the sequence of transcripts whose cDNA at least partially corresponds to SEQ ID NO:73, SEQ ID NO:74 and/or SEQ ID NO:75 is suitable. The prediction of the response to immunotherapy comprises in particular pharmaceutical compounds which are suitable for inhibiting the receptor encoded by PDCD1 and/or its ligands, the ligands being encoded in particular by the immunoregulatory genes PDCD1LG2 and CD274. Examples are nivolumab (trade name: Opdivo, manufacturer: Bristol-Myers Squibb), pembrolizumab (trade name: Keytruda; manufacturer: Merck/MSD Sharp & Dohme), pidilizumab (CT-011, manufacturer: CureTech Ltd.), MGD013 (Macrogenics), AMP-224 (manufacturer: GlaxoSmithKline), MEDI0680 (AMP-514, manufacturer: MedImmune LLC), AUNP-12 (manufacturer: Aurigene Discovery Technologies Ltd.), BMS935559 (MDX 1105, manufacturer: Bristol-Myers Squibb), CA-170 (manufacturer: Curis Inc.), MPDL3280A (manufacturer: Roche), MEDI4736 (manufacturer: AstraZeneca), avelumab (MSB0010718C, manufacturer: Pfizer) and rHIgM12B7 (B7-DC cross-linking antibody rHIgM12B7, Mayo Clinic).

The gene CD274 or CD274 molecule, respectively, is also known under the synonyms PDCD1L1, B7-H, B7-H1, PDCD1LG1, PD-L1, PDL1 and B7H1. CD274 is an immunoregulatory gene encoding a B7 protein, which is an immune checkpoint in the sense of the present invention. CD274 encodes a protein which is a ligand of the receptor encoded by PDCD1. CD274 belongs to the immunoglobulin superfamily. Preferred regions for the DNA methylation analysis of CD274 are contained in the region encoding the transcripts (9:5450503-5470566, SEQ ID NO:1) and the promoters (9:5445402-5456799, SEQ ID NO:76 and 9:5458041-5461360, SEQ ID NO:77), enhancers (9:5457122-5457702, SEQ ID NO:78; 9:5463574-5468340, SEQ ID NO:79; 9:5440647-5441785, SEQ ID NO:80 and 9:5472191-5473149, SEQ ID NO:81) and/or CTCF binding sites (9:5440970-5441435, SEQ ID NO:82 and 9:5446325-5446870, SEQ ID NO:83). Further preferred regions for the DNA methylation analysis include the coding region of CD274 which contains an alternative promoter and a CTCF binding site (9:5451072-5481072, SEQ ID NO:371), the alternative promoter (9:5451072-5461819, SEQ ID NO:375), the regulatory region upstream of the promoter 9:5433159-5449887, SEQ ID NO:370), the region upstream of the promoter containing a CTCF binding site (9:5439290-5449887, SEQ ID NO:376), the coding region downstream of the promoter (9:5451072-5470566, SEQ ID NO:372), and the region downstream of the coding region comprising a CTCF binding site and an enhancer (9:5470566-5496357, SEQ ID NO:373). Other preferred regions for the DNA methylation analysis of CD274 are selected from those described for this purpose in examples 2, 3, 7, 8, 10, 12, 15 and 17. For the mRNA expression analysis according to the present invention, the detection of at least part of the sequence of transcripts whose cDNA at least partially corresponds to SEQ ID NO:28, SEQ ID NO:101, SEQ ID NO:102, SEQ ID NO:103 and/or SEQ ID NO:104 is suitable. The prediction of the response to immunotherapy comprises, in particular, pharmaceutical compounds which inhibit the B7 protein encoded by CD274 and/or the corresponding receptor encoded by PDCD1 and/or the ligand encoded by PDCD1LG2 which also binds to the receptor encoded by PDCD1. Examples are nivolumab, pembrolizumab, pidilizumab, AMP-224, AMP-514, AUNP-12, BMS935559, CA-170 (Curis), atezolizumab (MPDL3280A, Roche, Genentech), MGD013 (Macrogenics), MEDI4736, CA-170 (Curis, Inc.), and avelumab.

The gene PDCD1LG2 or programmed cell death 1 ligand 2 is also known under the synonyms Btdc, PDL2, CD273, PDCD1L2, B7-DC, bA574F11.2, PD-L2 and B7DC. PDCD1LG2 is an immunoregulatory gene encoding a B7 protein, which is an immune checkpoint in the sense of the present invention. PDCD1LG2 encodes a B7 protein which is a ligand of the PDCD1 encoded receptor.

PDCD1LG2 belongs to the immunoglobulin superfamily. Preferred regions for the DNA methylation analysis of PDCD1LG2 are contained in the region encoding the transcript (9:5510570-5571254) and the promoter (9:5507688-5523442, SEQ ID NO:84; 9:5491444-5503289, SEQ ID NO:85; 9:5528150-5534251, SEQ ID NO:86 and 9:5547972-5571492, SEQ ID NO:87) and/or the enhancer (9:5479110-5491616, SEQ ID NO:88; 9:5522642-5528253, SEQ ID NO:89; 9:5534822-5547690, SEQ ID NO:90; 9:5572730-5580962, SEQ ID NO:91), and the region upstream of the coding sequence (9:5496357-5510570, SEQ ID NO:374). The DNA methylation analysis particularly preferably comprises one or more of the CpG dinucleotides located in the sequence region 9:5433159-5603325 encoding the transcripts of the adjacent genes CD274 and PDCDILG2 and comprising enhancers and promoters of these genes, in particular the region between the coding regions of CD274 and PDCD1LG2 (9:5470566-5510570; SEQ ID NO:485). Other preferred areas for the methylation analysis of PDCD1LG2 are selected from those described for this purpose in examples 3, 5, 7, 8, 10 and 13. For the mRNA expression analysis of the present invention, at least part of the sequence of the transcript whose cDNA at least partially corresponds to SEQ ID NO:105 can be determined. The prediction of the response to immunotherapy includes in particular pharmaceutical compounds that inhibit the B7 protein encoded by PDCD1LG2 and/or the corresponding receptor encoded by PDCD1. Suitable inhibitors are for example nivolumab, pembrolizumab, pidilizumab, AMP-224, AMP-514, AUNP-12, CA-170 (Curis, Inc.) and rHIgM12B7.

The gene ICOS or inducible T-cell co-stimulator is also known under the synonyms CD278, CVID1, and AILIM. ICOS is an immunoregulatory gene encoding a protein which is an immune checkpoint in the sense of the present invention. ICOS is a receptor and can, for example, bind the ligand belonging to the B7 proteins which is encoded by the gene ICOSLG. ICOSLG or inducible T-cell co-stimulator ligand is an immunoregulatory gene and encodes a ligand that is an immune checkpoint in the sense of the present invention. ICOSLG is also referred to as ICOSL, B7RP1, LICOS, B7RP-1, KIAA0653, GL50, ICOS-L, CD275, B7H2 and B7-H2. ICOS and ICOSLG belong to the immunoglobulin superfamily. Preferred areas for ICOS DNA methylation analysis are contained in the region encoding the transcript (2:203936748-203961577, SEQ ID NO:92) and the promoters (2:203934590-203941036, SEQ ID NO:93 and 2:203948548-203953636, SEQ ID NO:94) and/or the enhancer (2:203931099-203937863, SEQ ID NO:95 and 2:203940518-203949061, SEQ ID NO:96). Preferred regions for the DNA methylation analysis of ICOSLG are contained in the region encoding the transcripts (21: 44222991-44240966, SEQ ID NO:97) and a CpG island (21:44240132-44243380, SEQ ID NO:98), the promoter (21:44238919-44247988, SEQ ID NO:99) and/or an enhancer region (21:44214476-44227512, SEQ ID NO:100). Other preferred regions for the DNA methylation analysis of ICOS and ICOSLG are selected from those described for this purpose in examples 11, 13 and 17. For the mRNA expression analysis according to the present invention of ICOS and ICOSLG, respectively, the detection of at least part of the sequence of transcripts whose cDNA at least partially corresponds to SEQ ID NO:106, SEQ ID NO:107, SEQ ID NO:108, SEQ ID NO:109, SEQ ID NO:110 and/or SEQ ID NO:111 is suitable. In a preferred embodiment, the method comprises the implementation of the DNA methylation analysis of the ICOS and/or ICOSLG gene to determine the response to a pharmaceutical compound which is capable of modifying the immunoregulatory effect of ICOS and/or ICOSLG, in particular activating the ICOS encoded receptor. A suitable activator is for example JTX-2011 (Jounce Therapeutics).

The gene CTLA4 or cytotoxic T-lymphocyte-associated protein 4 is also known under the synonyms CELIAC3, GRD4, CTLA-4, IDDM12, CD, CD28, GSE, CD152 and ALPS5. CTLA4 is an immunoregulatory gene encoding a protein which is an immune checkpoint in the sense of the present invention. CTLA4 encodes a receptor that can, for example, bind the ligand belonging to the B7 proteins which is encoded by the gene CD80. CD80 or CD80 molecule is an immunoregulatory gene and encodes a ligand that is an immune checkpoint in the sense of the present invention. CD80, for example, is also named B7, CD28LG1, B7.1, B7-1, LAB7, BB1 and CD28LG. CTLA4 and CD80 belong to the immunoglobulin superfamily. Preferred regions for the methylation analysis of CTLA4 are contained in the region coding for the transcripts (2:203867786-203873960, SEQ ID NO:160) and the promoters (2:203866174-203868926, SEQ ID NO:162 and 2:203869477-203874095, SEQ ID NO:164), the enhancer (2:203874152-203875266, SEQ ID NO:165; 2:203876672-203878051, SEQ ID NO:166 and 2:203879313-203881585, SEQ ID NO:167) and/or the region between CTLA4 and the adjacent immunoregulatory gene LCOS (2:203872383-203939876). Other preferred regions for the DNA methylation analysis of CTLA4 are selected from those described for this purpose in examples 4, 7, 8, 11, 13, 15 and 16. Preferred regions for the DNA methylation analysis of CD80 are contained, for example, in the region encoding the transcripts (3:119524293-119559602) and the promoters (3:119554042-119563668, SEQ ID NO:163 and 3:119568227-119573274, SEQ ID NO:177) and/or the enhancer (3:119563379-119568778, SEQ ID NO:178; 3:119538188-119543511, SEQ ID NO:179 and 3:119545840-119554325, SEQ ID NO:180). Other preferred regions for the methylation analysis of CD80 are selected from those described for this purpose in examples 11, 13, 15 and 16. For the mRNA expression analysis of the present invention of CTLA4 and CD80, respectively, the determination of at least part of the sequence of transcripts whose cDNA at least partially corresponds to SEQ ID NO:168, SEQ ID NO:169, SEQ ID NO:170, SEQ ID NO:171, SEQ ID NO:172 and SEQ ID NO:173 and SEQ ID NO:174, SEQ ID NO:175 and/or SEQ ID NO:176, respectively, is suitable. A preferred method comprises the use of DNA methylation analysis of the CTLA4 and/or CD80 gene to predict the response to pharmaceutical compounds which are capable of modifying, in particular inhibiting, the immunoregulatory effect of CTLA4 and/or CD80. Suitable pharmaceutical compounds are, for example, ipilimumab (MDX-010; trade name Yervoy, Bristol-Myers Squibb), tremelimumab (ticilimumab, CP-675,206, Pfizer, MedImmune, Astra Zeneca).

Further immunoregulatory genes preferred for performing the method of the present invention, which encode B7 proteins, are the genes CD276, C10orf54, HHLA2, NCR3LG1, CD86 and VTCN1. The genes CD276, C10orf54, HHLA2, NCR3LG1, CD86 and VTCN1 encode immune checkpoints in the sense of the present invention, which also belong to the immunoglobulin superfamily. The gene CD276 or CD276 molecule, respectively, is also referred to as B7-H3, B7H3, 41g-B7-H3 and B7RP-2. Preferred regions for the DNA methylation analysis of CD276 are contained, for example, in the region coding for the transcripts (15:73683966-73714518, SEQ ID NO:181) and promoters (15:73679515-73692168, SEQ ID NO:182 and 15:73693817-73698829, SEQ ID NO:184), a CpG island (15:73683810-73685004, SEQ ID NO:183), a CTCF and transcription factor binding site (15:73699041-73706032, SEQ ID NO:185) and enhancers (15:73674927-73679619, SEQ ID NO:186 and 15:73710442-73723236, SEQ ID NO:187). Other preferred regions for the methylation analysis of CD276 are selected from those described for this purpose in examples 13, 15, 16 and 17. For the mRNA expression analysis of the present invention of CD276, the detection of at least part of the sequence of transcripts whose cDNA at least partially corresponds to the sequences SEQ ID NO:241, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:251, SEQ ID NO:252 and/or SEQ ID NO:253. A preferred embodiment of the method comprises the use of the DNA methylation analysis of the CD276 gene to determine the response to pharmaceutical compound capable of modifying, in particular inhibiting, the immunoregulatory effect of CD276. Suitable active substances are for example enoblituzumab (MGA271, Macrogenics) and MGD009 (Macrogenics).

The gene C10orf54 or chromosome 10 open reading frame 54 is also known as B7H5, GI24, PP2135, VISTA, B7-H5, DD1alpha and SISP1. Preferred regions for the DNA methylation analysis of C10orf54 are contained, for example, in the region encoding the transcripts (10:71747559-71773498, SEQ ID NO:188) and promoters (10:71759805-71784691, SEQ ID NO:189 and 10:71723534-71753287, SEQ ID NO:191) and/or a CTCF binding site (10:71738936-71750940, SEQ ID NO:190). Other preferred regions for the DNA methylation analysis of C10orf54 are selected from those described for this purpose in examples 11, 14 and 17. For the mRNA expression analysis of the present invention of C10orf54, the determination of at least part of the sequence of transcripts whose cDNA at least partially corresponds to the sequences SEQ ID NO:192, SEQ ID NO:193 and/or SEQ ID NO:194 is suitable. A preferred embodiment of the method comprises the use of the DNA methylation analysis of the C10orf54 gene to determine the response to a pharmaceutical compound which is capable of modifying, in particular inhibiting, the immunoregulatory effect of C10orf54. Suitable inhibitors include for instance CA-170 (Curis) and JNJ-61610588 (Janssen Biotech, Inc.).

The gene HHLA2 or HERV-H LTR-associating 2 is also known as B7-H7, B7y, B7H7 and B7-H5. Preferred regions for the DNA methylation analysis of HHLA2 are contained, for example, in the region coding for transcripts (3:108296490-108378285) and a regulatory region with enhancers, promoters and CTCF binding sites (3:108291804-108313328, SEQ ID NO:36) and two other promoters (3:108310655-108313476, SEQ ID NO:195 and 3:108341108-108352706, SEQ ID NO:196). Other preferred regions for the DNA methylation analysis of HHLA2 are selected from those described for this purpose in examples 11, 14, 15 and 16. For the mRNA expression analysis of HHLA2 according to the present invention, the determination of at least part of the sequence of transcripts whose cDNA at least partially corresponds to the sequences SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206 and/or SEQ ID NO:207 is suitable. A preferred embodiment of the method comprises using the DNA methylation analysis of the HHLA2 gene to determine the response to a pharmaceutical compound capable of modifying, in particular inhibiting, the immunoregulatory effect of HHLA2.

The gene NCR3LG1 or natural killer cell cytotoxicity receptor 3 ligand 1 is also known as B7H6, DKFZp686O24166 and B7-H6. NCR3LG1 is an immunoregulatory gene whose product belongs to the B7 proteins and is an immune checkpoint according to the present invention. Preferred regions for the DNA methylation analysis of NCR3LG1 are contained, for example, in the region coding for the transcripts (11:17351726-17377341, SEQ ID NO:208) and the promoter (11:17347524-17359073, SEQ ID NO:209) and/or a CpG island (11:17351068-17354459, SEQ ID NO:210). For the mRNA expression analysis of NCR3LG1 of the present invention, the determination of at least part of the sequence of transcripts whose cDNA at least partially corresponds to SEQ ID NO:254 and/or SEQ ID NO:255 is suitable. A preferred embodiment of the method comprises using the DNA methylation analysis of the NCR3LG1 gene to determine the response to a pharmaceutical compound capable of altering the immunoregulatory effect of NCR3LG1 and/or the receptor encoded by NCR3.

The gene CD86 or CD86 molecule is also known as B7-2, B70, LAB72, B7.2 and CD28LG2. The ligand encoded by CD86 belongs to the B7 proteins and is an immune checkpoint in the sense of the present invention that can bind to the receptors encoded by CD28 and CTLA4, for example. Preferred regions for the DNA methylation analysis of CD86 are contained, for example, in the region encoding the transcripts (3:122055366-122121139), the promoters (3:122071817-122084231, SEQ ID NO:211; 3:122053987-122061537, SEQ ID NO:212; 3:122081939-122095873, SEQ ID NO:213; 3:122096457-122110191, SEQ ID NO:214) and/or the enhancer (3:122119408-122125888, SEQ ID NO:215). Other preferred regions for the methylation analysis of CD86 are selected from those described for this purpose in Example 17. For the mRNA expression analysis of CD86 of the present invention, the determination of at least part of the sequence of transcripts whose cDNA at least partially corresponds to SEQ ID NO:256, SEQ ID NO:257, SEQ ID NO:258, SEQ ID NO:259, SEQ ID NO:260, SEQ ID NO:261, SEQ ID NO:262, SEQ ID NO:263 and/or SEQ ID NO:264 is suitable. A preferred embodiment of the method comprises using the DNA methylation analysis of the CD86 gene to determine the response to a pharmaceutical compound capable of inhibiting the immunoregulatory effect of the ligand encoded by CD86 and/or the receptors encoded by CTLA4 and/or CD28. Suitable pharmaceutical compounds are for example ipilimumab (MDX-010; trade name Yervoy, Bristol-Myers Squibb), tremelimumab (ticilimumab, CP-675,206, Pfizer, MedImmune, Astra Zeneca).

The gene VTCN1 or V-set domain containing T-cell activation inhibitor 1 is also known as B7-H4, B7H4, B7S1, B7X, B7h.5, PRO1291 and VCTN1. The protein encoded by VTCN1 belongs to the B7 proteins and is an immune checkpoint in the sense of the present invention. Preferred regions for the DNA methylation analysis of VTCN1 are contained, for example, in the region coding for the transcripts (1:117143587-117210960) and/or the promoter (1:117193851-117226364). For the mRNA expression analysis of VTCN1 according to the present invention, the determination of at least part of the sequence of transcripts whose cDNA at least partially corresponds to SEQ ID NO:377, SEQ ID NO:378 and/or SEQ ID NO:379 is suitable. A preferred embodiment of the method comprises the use of the DNA methylation analysis of the VTCN1 gene to determine the response to a pharmaceutical compound capable of inhibiting the immunoregulatory effect of the ligand encoded by VTCN1 and/or its receptor.

The immunoregulatory genes KIR2DL4, KIR3DL1, KIR3DL3, LAG3, and CD160 encode proteins which are MHC:peptide complex binding co-receptors. KIR2DL4, KIR3DL1, KIR3DL3, LAG3, and CD160 are immune checkpoints in the sense of the present invention and belong to the immunoglobulin superfamily. The KIR genes KIR2DL4, KIR3DL1 and KIR3DL3 encode killer cell immunoglobulin-like receptors (KIR or KIR receptors for short). The gene KIR2DL4 or killer cell immunoglobulin-like receptor, two domains, long cytoplasmic tail, 4 is also known as KIR103, KIR103AS, G9P, CD158D, 15.212, KIR-103AS and 103AS. Preferred regions for the DNA methylation analysis of KIR2DL4 are, for example, contained in the region encoding the transcripts (19:54803535-54814517, SEQ ID NO:216), in the promoters (19:54799627-54807083, SEQ ID NO:217; 19:54791651-54800236, SEQ ID NO:229) and/or two enhancers (19:54803283-54804114, SEQ ID NO:218 and 19:54812823-54819942, SEQ ID NO:219). Other preferred regions for the methylation analysis of KIR2DL4 are selected from those described for this purpose in examples 11, 14 and 17. For the mRNA expression analysis of KIR2DL4 of the present invention, the detection of at least part of the sequence of transcripts whose cDNA at least partially corresponds to SEQ ID NO:220, SEQ ID NO:221, SEQ ID NO:222, SEQ ID NO:223, SEQ ID NO:224, SEQ ID NO:225, SEQ ID NO:226, SEQ ID NO:227 and/or SEQ ID NO:228 is suitable. A preferred embodiment of the method comprises using the DNA methylation analysis of the KIR2DL4 gene to determine the response to a pharmaceutical compound capable of inhibiting the immunoregulatory effect of the receptor encoded by KIR2DL4. Lirilumab (Bristol-Myers Squibb), for example, is a suitable pharmaceutical compound.

The gene KIR3DL1 or killer cell immunoglobulin-like receptor, three domains, long cytoplasmic tail, 1 is also known as NKB1, CD158E, cl-11, cl-2, CD158e2, NKAT3, AMB11, NKB1B, KIR, KIR3DL2, CD158E1, CD158e1/2, NKAT-3, nkat3 and KIR3DL1/S1. Preferred regions for the DNA methylation analysis of KIR3DL1 include, for example, the region coding for transcripts (19:54816468-54866993), the promoter (19:54808180-54831092, SEQ ID NO:230) and/or two enhancers (19:54812749-54821037, SEQ ID NO:231 and 19:54835785-54863422, SEQ ID NO:232). Other preferred regions for the DNA methylation analysis of KIR3DL1 are selected from those described for this purpose in examples 11 and 14. For the mRNA expression analysis of KIR3DL1 according to the present invention, the determination of at least part of the sequence of transcripts whose cDNA at least partially corresponds to SEQ ID NO:233, SEQ ID NO:234, SEQ ID NO:235 and/or SEQ ID NO:236 is suitable. A preferred embodiment of the method comprises the use of the methylation analysis of the KIR3DL1 gene to determine the response to a pharmaceutical compound which is capable of inhibiting the immunoregulatory effect of the KIR3DL1 encoded receptor, such as lirilumab (also known as IPH2102/BMS-986015 from Bristol-Myers Squibb and Innate Pharma) and IPH4102 (Innate Pharma).

The gene KIR3DL3 respectively killer cell immunoglobulin-like receptor, three domains, long cytoplasmic tail, 3 is also known as KIR2DS2, CD158z, KIR3DL7, KIR44, CD158Z and KIRC1. Preferred regions for the DNA methylation analysis of KIR3DL3 are contained in the region encoding the transcripts (19:54724479-54736536, SEQ ID NO:237) as well as in the promoter (19:54723156-54728908, SEQ ID NO:238) and/or two enhancers (19:54723473-54725230, SEQ ID NO:239 and 19:54735023-54744608, SEQ ID NO:240). For the mRNA expression analysis of KIR3DL3 according to the present invention, the determination of at least part of the sequence of transcripts whose cDNA at least partially corresponds to SEQ ID NO:265 is suitable. A preferred embodiment of the method comprises the use of the DNA methylation analysis of the KIR3DL3 gene to determine the response to a drug capable of inhibiting the immunoregulatory effect of the receptor encoded by KIR3DL3, such as lirilumab (also known as IPH2102/BMS-986015 from Bristol-Myers Squibb and Innate Pharma).

The gene LAG3 or lymphocyte-activation gene 3, respectively, is also called FDC and CD223. Preferred regions for the methylation analysis of LAG3 are, for example, the region coding for the transcripts (12:6772512-6778455, SEQ ID NO:161) and the promoter (12:6770333-6774801, SEQ ID NO:349), an alternative promoter with CTCF binding site (12:6777768-6781320, SEQ ID NO:350) and an enhancer (12:6774685-6778062, SEQ ID NO:351). Other preferred areas for the DNA methylation analysis of LAG3 are selected from those described for this purpose in examples 4, 7, 8, 9 and 14. For the determination of the mRNA of LAG3 according to the invention, for example the sequences or parts of the sequences SEQ ID NO:352, SEQ ID NO:353, SEQ ID NO:354 and SEQ ID NO:355 are preferred. In a preferred embodiment of the method, the methylation analysis of the LAG3 gene is used to determine the response to an inhibitor capable of inhibiting the immunoregulatory effect of the LAG3 encoded receptor. Suitable inhibitors include for instance MGD013 (Macrogenics) and BMS-986016 (Bristol-Myers Squibb).

The gene CD160 or CD160 molecule is also known as BY55, NK28 and NK1. Preferred regions for the DNA methylation analysis of CD160 are contained, for example, in the region encoding the transcripts (1:145719471-145739288, SEQ ID NO:361) and the promoter (1:145718367-145722818, SEQ ID NO:362), an alternative promoter (1:145735798-145741393, SEQ ID NO:364), a CTCF binding site (1:145720204-145722255, SEQ ID NO:363) and/or two enhancers (1:145727546-145735069, SEQ ID NO:365 and 1:145708511-145719786, SEQ ID NO:366). Other preferred regions for the DNA methylation analysis of CD160 are selected from those described for this purpose in examples 11, 14 and 17. For the mRNA expression analysis of CD160 according to the invention, the detection of at least part of the sequence of transcripts whose cDNA at least partially corresponds to SEQ ID NO:356, SEQ ID NO:357, SEQ ID NO:358, SEQ ID NO:359 and/or SEQ ID NO:360 is suitable. A preferred embodiment of the method comprises using the DNA methylation analysis of the CD160 gene to determine the response to a pharmaceutical compound capable of modifying, in particular inhibiting, the immunoregulatory effect of the receptor encoded by CD160.

The immunoregulatory genes TIGIT, BTLA, HAVCR2, BTNL2 and CD48 encode the proteins TIGIT, BTLA, HAVCR2, BTLN2 and CD48, which belong to the immunoglobulin superfamily and are immune checkpoints in the sense of the present invention.

The gene TIGIT or T-cell immunoreceptor with Ig and ITIM domains is also known as DKFZp667A205, VSIG9, VSTM3, FLJ39873 and WUCAM. Preferred regions for the DNA methylation analysis of TIGIT are comprised in the region coding for transcripts (3:114276913-114310288) and three regulatory regions with enhancers and CTCF binding sites (3:114273873-114278448, SEQ ID NO:266; 3:114306113-114321848, SEQ ID NO:267; 3:114288458-114302904, SEQ ID NO:268). Other preferred regions for the DNA methylation analysis of TIGIT are selected from those described for this purpose in examples 4, 7, 8, 11, 14, 15, 16 and 17. For the mRNA expression analysis of TIGIT according to the present invention, the determination of at least part of the sequence of transcripts whose cDNA at least partially corresponds to SEQ ID NO:269, SEQ ID NO:270, SEQ ID NO:271, SEQ ID NO:272, SEQ ID NO:273, SEQ ID NO:274 and/or SEQ ID NO:275 is suitable. A preferred embodiment of the method involves the use of the methylation analysis of the TIGIT gene to determine the response to a pharmaceutical compound capable of modifying, in particular inhibiting, the immunoregulatory effect of TIGIT.

The gene BTLA or B and T lymphocyte associated is also known as CD272 and BTLA1. Preferred regions for the DNA methylation analysis of BTLA are contained, for example, in the region encoding the transcripts (3:112463968-112499561) and the promoter (3:112494210-112503447, SEQ ID NO:276), an alternative promoter (3:11246068682-112487674, SEQ ID NO:279) and/or the enhancer (3:112501618-112513121, SEQ ID NO:277; 3:112486680-112495554, SEQ ID NO:278; 3:112451208-112463106, SEQ ID NO:280; 3:112508297-112522457, SEQ ID NO:281). Other preferred regions for BTLA DNA methylation analysis are selected from those described for this purpose in examples 4, 6, 7, 8, 11 and 14. For the mRNA expression analysis of BTLA according to the invention, the detection of at least part of the sequence of transcripts whose cDNA at least partially corresponds to SEQ ID NO:282, SEQ ID NO:283, SEQ ID NO:284 and/or SEQ ID NO:285 is suitable. A preferred embodiment of the method comprises the use of the DNA methylation analysis of the BTLA gene to determine the response to a pharmaceutical compound which is capable of modifying, in particular inhibiting, the immunoregulatory effect of BTLA.

The gene HAVCR2 or hepatitis A virus cellular receptor 2 is also referred to as TIMD-3, CD366, Tim-3, TIMD3, FLJ14428, TIM3, HAVcr-2 and KIM-3. Preferred regions for the DNA methylation analysis of HAVCR2 are contained in the region encoding the transcripts (5:157085832-157142869) and the promoter (5:157138356-157147783, SEQ ID NO:286), an alternative promoter (5:157097106-157121624, SEQ ID NO:287) and three enhancers (5:157144698-157161450, SEQ ID NO:288; 5:157116666-157139926, SEQ ID NO:289 and 5:157080879-157096259, SEQ ID NO:290). Other preferred regions for the DNA methylation analysis of HAVCR2 are selected from those described for this purpose in examples 11 and 14. For the mRNA expression analysis of HAVCR2 of the present invention, the detection of at least part of the sequence of transcripts whose cDNA at least partially corresponds to SEQ ID NO:291, SEQ ID NO:292, SEQ ID NO:293, SEQ ID NO:294, SEQ ID NO:295 and/or SEQ ID NO:296 is suitable. A preferred embodiment of the method comprises the use of the DNA methylation analysis of the HAVCR2 gene to determine the response to pharmaceutical compound capable of altering, for example inhibiting, the immunoregulatory effect of HAVCR2. A suitable inhibitor is anti-TIM-3 antibody TSR-022 (Tesaro, Inc).

The gene BTNL2 respectively butyrophilin like 2 is also known as BTL-II, BTN7, HSBLMHC1 and SS2. Preferred regions for the DNA methylation analysis of BTNL2 comprise the region encoding the transcripts (6:32393963-32407128, SEQ ID NO:387) and the region with promoter and regulatory elements (6:32387381-32413712, SEQ ID NO:387). Other preferred regions for the DNA methylation analysis of BTNL2 are selected from those described for this purpose in example 17. For the mRNA expression analysis of BTNL2 according to the invention, the detection of at least part of the sequence of transcripts whose cDNA at least partially corresponds to SEQ ID NO:389 is suitable. A preferred embodiment includes the use of the DNA methylation analysis of the BTNL2 gene to determine the response to a pharmaceutical compound that is capable of altering the immunoregulatory effect of BTNL2. This includes in particular an antagonist capable of inhibiting the immune checkpoint encoded by BTNL2.

The gene CD48 or CD48 molecule is also called BCM1, BLAST, BLAST1, MEM-102, SLAMF2, hCD48 and mCD48. Preferred regions for the DNA methylation analysis of CD48 comprise the promoter and regulatory elements (1:160676386-160722581) as well as the promoter (1:160703189-160716911, SEQ ID NO:390). Other preferred regions for the DNA methylation analysis of CD48 are selected from those described for this purpose in example 17. For the mRNA expression analysis of CD48 according to the invention, the detection of at least part of the sequence of transcripts whose cDNA at least partially corresponds to SEQ ID NO:389 is suitable. A preferred embodiment comprises the use of the DNA methylation analysis of the CD48 gene to determine the response to a pharmaceutical compound capable of altering the immunoregulatory effect of CD48.

CD40, TNFRSF9, TNFRSF18, TNFRSF4 and CD27 are immunoregulatory genes coding for the proteins CD40, TNFRSF9, TNFRSF18, TNFRSF4 and CD27. CD40, TNFRSF9, TNFRSF18, TNFRSF4 and CD27 are receptors of the tumor necrosis factor receptor superfamily, which are immune checkpoints in the sense of the present invention.

The gene CD40 respectively CD40 molecule, TNF receptor superfamily member 5 is also referred to as TNFRSF5, p50, Bp50 and CDW40. Preferred regions for the DNA methylation analysis of CD40 are contained in the region encoding the transcripts (20:46118272-46129863, SEQ ID NO:297) as well as the promoter (20:46115599-46122305, SEQ ID NO:298), an alternative promoter (20:46106713-46115878, SEQ ID NO:299) and/or the enhancer (20: 46121274-46143091, SEQ ID NO:300). Other preferred regions for the DNA methylation analysis of CD40 are selected from those described for this purpose in examples 4, 7, 8, 9 and 14. For the mRNA expression analysis of CD40 of the invention, the detection of at least part of the sequence of transcripts whose cDNA at least partially corresponds to SEQ ID NO:301, SEQ ID NO:302, SEQ ID NO:303, SEQ ID NO:304, SEQ ID NO:305, SEQ ID NO:306 and/or SEQ ID NO:307 is suitable. A preferred embodiment comprises the use of the DNA methylation analysis of the CD40 gene to determine the response to a pharmaceutical compound capable of altering the immunoregulatory activity of CD40. This includes in particular an agonist which is capable of activating the receptor encoded by CD40 such as CP-870, 893 (Pfizer, VLSI), dacetuzumab (Seattle Genetics), Chi Lob 7/4 (University of Southampton). In particular, the pharmaceutical compound may also be chosen in such a way that it is able to inhibit the immunoregulatory effect of CD40. Lucatumumab (Novartis), for example, is a suitable pharmaceutical compound.

The gene TNFRSF9 or tumor necrosis factor receptor superfamily member 9 is also known as 4-1BB, CDw137, CD137 and ILA. Preferred regions for the DNA methylation analysis of TNFRSF9 are in the regions encoding the transcripts (1:7915894-7943165, SEQ ID NO:308) and the promoter (1:7937419-7950341, SEQ ID NO:309), a regulatory element with CTCF binding site, enhancer and alternative promoter (1:7910016-7923298, SEQ ID NO:312), the enhancer (1:7922095-7939183, SEQ ID NO:310) and/or a CpG island (1:7949284-7956816, SEQ ID NO:311). Other preferred areas for the DNA methylation analysis of TNFRSF9 are selected from those described for this purpose in examples 4, 7, 8, 11, 14, 15, 16 and 17. For the mRNA expression analysis of TNFRSF9 of the invention, the detection of at least part of the sequence of transcripts whose cDNA at least partially corresponds to SEQ ID NO:313, SEQ ID NO:314, SEQ ID NO:315 and/or SEQ ID NO:316 is suitable. A preferred embodiment of the method comprises the use of the DNA methylation analysis of the TNFRSF9 gene to determine the response to a pharmaceutical compound capable of altering the immunoregulatory activity of TNFRSF9, in particular an agonist capable of activating the receptor encoded by TNFRSF9. Suitable pharmaceutical compounds are PF-05082566 (PF-566, Pfizer) and urelumab (BMS-663513, Bristol-Myers Squibb).

The gene TNFRSF25 or tumor necrosis factor receptor superfamily member 25 is also known as WSL-LR, WSL, APO3, TNFRSF12, TR3, LARD, DDR3, TRAMP, WSL-1, DR3, WSL1 and APO-3. Preferred regions for the DNA methylation analysis of TNFRSF25 are contained in the region coding for the transcripts (1:6461151-6466195, SEQ ID NO:317) and an alternative promoter (1:6458470-6463974, SEQ ID NO:318), two CpG islands (1:6459713-6463353, SEQ ID NO:319; 1:6465602-6466846, SEQ ID NO:320) and a further promoter (1:6464008-6468536, SEQ ID NO:321) and/or an enhancer (1:6468908-6478190, SEQ ID NO:322). Other preferred regions for the DNA methylation analysis of TNFRSF25 are selected from those described for this purpose in the examples 14 and 17. For the mRNA expression analysis of TNFRSF25 according to the invention, the detection of at least part of the sequence of transcripts whose cDNA at least partially corresponds to SEQ ID NO:323, SEQ ID NO:324, SEQ ID NO:325, SEQ ID NO:326, SEQ ID NO:327 and/or SEQ ID NO:328 is suitable. A preferred embodiment of the method comprises the use of the DNA methylation analysis of the TNFRSF25 gene to determine the response to a pharmaceutical compound capable of altering the immunoregulatory effect of TNFRSF25. Preferably, it is an agonist which is suitable for activating the receptor encoded by TNFRSF25.

The gene TNFRSF18 respectively tumor necrosis factor receptor superfamily member 18 is also known as GITR, AITR, CD357 and GITR-D. Preferred regions for the DNA methylation analysis of TNFRSF18 are contained in the region coding for the transcripts (1:1203508-1206691, SEQ ID NO:329) and/or the promoter (1:1195867-1210392, SEQ ID NO:330). For the mRNA expression analysis of TNFRSF18 according to the invention, the detection of at least part of the sequence of transcripts whose cDNA at least partially corresponds to SEQ ID NO:331, SEQ ID NO:332, SEQ ID NO:333 and/or SEQ ID NO:334 is suitable. Other preferred regions for the methylation analysis of TNFRSF18 are selected from those described for this purpose in example 17. A preferred embodiment of the method comprises the use of the DNA methylation analysis of the TNFRSF18 gene to determine the response to a pharmaceutical compound that is capable of altering the immunoregulatory effect of TNFRSF18. This includes in particular an agonist which is suitable to activate the receptor encoded by TNFRSF18, e.g. TRX518 (GITR Inc.).

The gene TNFRSF4 or tumor necrosis factor receptor superfamily member 4, respectively, is also known as IMD16, OX40, TXGP1L, CD134 and ACT35. Preferred regions for the DNA methylation analysis of TNFRSF4 are contained, for example, in the region encoding the transcripts (1:1211326-1214138, SEQ ID NO:335), the promoter (1:1209894-1215938, SEQ ID NO:336) and/or a CpG island (1:1213505-1214288, SEQ ID NO:337). For the mRNA expression analysis of TNFRSF4 according to the invention, the detection of at least part of the sequence of transcripts whose cDNA at least partially corresponds to SEQ ID NO:338, SEQ ID NO:339 and/or SEQ ID NO:340 is suitable. Other preferred regions for the methylation analysis of TNFRSF4 are selected from those described for this purpose in example 17. A preferred embodiment of the method comprises the use of the DNA methylation analysis of the TNFRSF4 gene to determine the response to a pharmaceutical compound that is capable of altering the immunoregulatory effect of TNFRSF4. Particularly preferred is an agonist which is suitable to activate the receptor encoded by TNFRSF4, such as MEDI6469 (9B12, MedImmune LLC, Astra Zeneca, AgonOx), Hu106-22 and Hu 119-122 (UTMDACC).

The gene CD27 or CD27 molecule, respectively, is also referred to as 5152, T14, TNFRSF7, S152, LPFS2 or Tp55. Preferred regions for the DNA methylation analysis of CD27 include, for example, the region coding for the transcripts (12:6444867-6451718, SEQ ID NO:341), two promoters (12:6442585-6448021, SEQ ID NO:342 and 12:6448982-6453895, SEQ ID NO:343) and/or three enhancers (12:6453736-6456010, SEQ ID NO:344; 12:6447474-6449430, SEQ ID NO:345 and 12:6439173-6442795, SEQ ID NO:346). Other preferred regions for the DNA methylation analysis of CD27 are selected from those described for this purpose in examples 6 and 17. For the mRNA expression analysis of CD27, the detection of at least part of the sequence of transcripts whose cDNA at least partially corresponds to SEQ ID NO:347 and/or SEQ ID NO:348 is suitable. A preferred embodiment of the method involves the use of the DNA methylation analysis of the CD27 gene to determine the response to a pharmaceutical compound which is capable of altering the immunoregulatory effect of CD27. This may in particular be an agonist capable of activating the receptor encoded by CD27, e.g. varlilumab (Celldex Therapeutics).

The ADORA2A gene is an immunoregulatory gene encoding the adenosine 2A receptor. The adenosine 2A receptor is an immune checkpoint in the sense of the present invention, which acts immunoregulatory by binding the metabolite adenosine. The gene ADORA2A or adenosine A2a receptor is also known as A2aR, ADORA2 or RDC8. Preferred regions for the DNA methylation analysis of ADORA2A are contained, for example, in the region coding for the transcripts (22:24417879-24442360, SEQ ID NO:380), in the promoter with a CpG island (22:24422358-24434469, SEQ ID NO:381), in an enhancer (22:24418577-24423493, SEQ ID NO:382) and in the region coding for ADORA2A and its antisense RNA (22:24420336-24501503). Other preferred regions for the DNA methylation analysis of ADORA2A are selected from those described for this purpose in the example 17. For the mRNA expression analysis of ADORA2A of the present invention, the detection of at least part of the sequence of transcripts whose cDNA at least partially corresponds to SEQ ID NO:383, SEQ ID NO:384, SEQ ID NO:385 and/or SEQ ID NO:386 is suitable. A preferred embodiment of the method comprises the use of the DNA methylation analysis of the ADORA2A gene to determine the response to a pharmaceutical compound capable of altering the immunoregulatory activity of the adenosine 2A receptor. Particularly preferred is an antagonist which is capable of inhibiting the receptor encoded by ADORA2A, such as PBF-509, istradefylline, ST1535, ST4206, tozadenant, V81444, CPI-444, preladenant, vipadenant, SCH58261, ATL801.

Alternatively, it is possible to perform the DNA methylation analysis of an immunoregulatory gene in combination with other prognostic and/or predictive biomarkers. In particular, mutations of the genes BRAF and EGFR are suitable for predicting a response to inhibitors of BRAF and EGFR. It is also possible to perform the methylation analysis of the immunoregulatory genes in combination with a methylation analysis and/or a mutation analysis of chemokines and chemokine receptors, e.g. of chemokine families CXC and CX3C. For example, a prediction of the response to therapy with ulocuplumab can be made. The methylation analysis of an immunoregulatory gene according to the present invention can also be combined with a methylation analysis of the IL2RB, CXCL12, CXCR4 and CXCR7 genes.

In general, the prognosis can also be assessed before, during or after immunotherapeutic treatment of the patient with at least one pharmaceutical compound designed to alter the immunoregulatory effect of the immune checkpoint. The prediction can also comprise the response of the patient's malignant disease to immunotherapy with at least one such pharmaceutical compound. The change in the immunoregulatory effect can be caused by the fact that the pharmaceutical compound interacts with the analyzed immune checkpoint itself or its receptor or ligand, respectively. For example, the immune checkpoint may comprise the ligand CD274 and/or PDCD1LG2 and the pharmaceutical compound may be designed to alter, in particular inhibit, the immunoregulatory effect of CD274 and/or PDCD1LG2 through interaction with the corresponding receptor PDCD1, for example by blocking the binding of CD274 or PDCD1LG2 to the PDCD1 receptor. In particular, so-called immune checkpoint inhibitors, which are able to reduce or prevent the immunoregulatory effect of a co-inhibitory or anti-inflammatory immune checkpoint, are considered as pharmaceutical compounds. Examples of such immune checkpoint inhibitors are nivolumab, ipilimumab, pembrolizumab and the other pharmaceutical compounds already mentioned above. Another possibility are pharmaceutical compounds that activate the immunoregulatory effect of the immune checkpoints of the present invention. Suitable activating pharmaceutical compounds include the compounds already mentioned above. It is also possible to make a selection of pharmaceutical compounds on the basis of the DNA methylation analysis of different immunoregulatory genes of the present invention for each of which a good response in immunotherapy is indicated. Such combination therapies are often particularly effective, but due to the high costs associated with them they require very careful consideration and therefore a particularly reliable prediction of the response behaviour to the individual pharmaceutical compounds. This is now possible for the first time with the method of the present invention.

This is also where the second aspect of the invention ties in, according to which a method is provided for the individualized selection of a pharmaceutical compound for the immunotherapeutic treatment of a patient with a malignant disease. The method is characterized in that a DNA methylation analysis of at least one immunoregulatory gene of cells of the malignant disease and/or of T lymphocytes interacting with said cells of the malignant disease is performed, wherein said immunoregulatory gene encodes an immune checkpoint selected from B7 proteins and their receptors (i.e. receptors which bind B7 proteins), MHC:peptide complex binding co-receptors, the members of the tumor necrosis factor receptor superfamily TNFRSF9, CD40, TNFRSF4, TNFRSF18 and CD27, the members of the immunoglobulin superfamily TIGIT, BTLA, HAVCR2, BTNL2 and CD48 and the adenosine-binding adenosine 2A receptor, and the pharmaceutical compound is selected on the basis of the result of the DNA methylation analysis.

The pharmaceutical compound can again be chosen so as to alter the immunoregulatory effect of said immune checkpoint, e.g. it is able to act as an immune checkpoint inhibitor that reduces or prevents the immunoregulatory effect of a co-inhibitory or anti-inflammatory immune checkpoint or it is able to act as an immune checkpoint agonist that enhances the immunoregulatory effect of a co-stimulatory or pro-inflammatory immune checkpoint. In particular, the pharmaceutical compound is selected if the DNA methylation analysis indicates an expression of the corresponding immune checkpoint in the cells of the malignant disease and/or in the T lymphocytes, since said expression of the immune checkpoint provides the target for the immunotherapeutic treatment with the pharmaceutical compound and consequently the response to a corresponding immunotherapy is sufficiently probable.

The third aspect of the invention therefore concerns the use of a DNA methylation analysis of at least one immunoregulatory gene of cells of a malignant disease of a patient and/or of T lymphocytes interacting with said cells of the malignant disease for assessing prognosis, prediction and/or individualized selection of a pharmaceutical compound for immunotherapeutic treatment of the patient. Here, too, the immunoregulatory gene codes for an immune checkpoint selected from B7 proteins and their receptors (i.e., receptors that bind B7 proteins), MHC:peptide complex binding co-receptors, the members of the tumor necrosis factor receptor superfamily TNFRSF9, CD40, TNFRSF4, TNFRSF18 and CD27, the members of the immunoglobulin superfamily TIGIT, BTLA, HAVCR2, BTNL2 and CD48, and the adenosine-binding adenosine 2A receptor.

The fourth aspect of the invention concerns the use of the presence, absence or level of methylation of at least one CpG dinucleotide of an immunoregulatory gene of cells of a malignant disease and/or of T lymphocytes interacting with said cells of the malignant disease as prognostic and/or predictive biomarker or as biomarker for the individualized selection of pharmaceutical compound for the immunotherapeutic treatment of the patient, wherein the immunoregulatory gene again encodes an immune checkpoint selected from B7 proteins and their receptors (i.e. receptors which bind B7 proteins), MHC:peptide complex binding co-receptors, the members of the tumor necrosis factor receptor superfamily TNFRSF9, CD40, TNFRSF4, TNFRSF18 and CD27, the members of the immunoglobulin superfamily TIGIT, BTLA, HAVCR2, BTNL2 and CD48, and the adenosine-binding adenosine 2A receptor.

Moreover, further features and preferred embodiments of the second, third and fourth aspect of the invention correspond, where applicable, to those of the first aspect.

According to the fifth aspect of the invention, a kit is provided for carrying out the method according to the first or second aspect or for the use according to the third or fourth aspect. The kit comprises at least one pair of oligonucleotides for the DNA methylation analysis, said pair of oligonucleotides being designed to hybridize to a sequence of the immunoregulatory gene in DNA from said cells of the malignant disease and/or from said T lymphocytes after cytosines contained in said DNA have been converted to uracil or another base having a base pairing behaviour and/or molecular weight which is distinguishable from that of cytosine in order to amplify and/or detect said sequence.

The kit may also comprise one or more additional oligonucleotide pairs, each designed to hybridize to additional sequences of the same immunoregulatory gene or other immunoregulatory genes in the converted DNA in order to amplify and/or detect the additional sequences for the DNA methylation analysis.

Furthermore, the kit may comprise at least one pair of oligonucleotides for the mRNA expression analysis, wherein said pair of oligonucleotides is designed to hybridize to a sequence of the mRNA or a cDNA generated from said mRNA of at least one transcript variant of the immunoregulatory gene from the cells of the malignant disease and/or from the T lymphocytes in order to amplify and/or detect the sequence.

Preferred regions and sequences of the immunoregulatory gene to be amplified and/or detected using said oligonucleotide pairs correspond to those of the first aspect.

The kit preferably comprises instructions for use for carrying out the method according to the first and/or second aspect and/or for the use according to the third or fourth aspect.

DETAILED DESCRIPTION OF EMBODIMENTS

In the following, the invention is described in more detail by way of examples and experimental results. These examples are intended as explanations and not as a limitation to specific details.

Example 1: Determination of the Prognosis of a Patient with Prostate Cancer after Radical Ectomy Using DNA Methylation Analysis of the Immunoregulatory Gene PDCD1

In one embodiment of the method according to the invention, the prognosis of a patient with a localized prostate carcinoma can be determined, for example after a radical removal (radical ectomy) of the prostate gland and the tumor located in the prostate.

Initially, the DNA was extracted from the tumor. For this purpose, lysis of tumor tissue using proteinase K with subsequent extraction of the DNA using silica centrifugation columns was suitable, for example. For the extraction of DNA from tumors, commercially available kits such as the QIAamp DNA Mini Kit (Qiagen N.V., Hilden, Germany) are available. The extracted DNA was then converted using bisulfate, so that essentially all cytosines were deaminated to uracil, while methylated cytosines remained unchanged. A genome-wide DNA methylation analysis was then performed, for which for example the Infinium Human Methylation450 BeadChip (Illumina, Inc., San Diego, Calif., USA) was suitable following the manufacturer's instructions. The generation of the HumanMethylation450 BeadChip raw data was performed as described by the TCGA Research Network. In total, raw data from tumors of 417 prostate cancer patients with known prognosis were generated and analyzed retrospectively.

For the DNA methylation analysis of the PDCD1 gene according to the present invention, a relative methylation level was first calculated using the raw data of the Human Methylation450 BeadChip. This was done using the CpG dinucleotides within the PDCD1 gene, which are covered by the bead pairs cg00795812, cg27051683, cg03889044, cg17322655 and cg20805133 of the Infinium Human Methylation450 BeadChip. These bead pairs bind to the bisulfite-converted DNA that had the sequences SEQ ID NO:20, SEQ ID NO:21, SEQ ID NO:22, SEQ ID NO:23 and SEQ ID NO:24 prior to conversion. At first, a methylation value was calculated from the raw data for each of the bead pairs mentioned and for each patient sample. This was done by correlating the signal of the bead of a pair that binds to the methylated variant (S_M) to the signal of the bead of the pair that binds to the unmethylated DNA (S_U). A bead comprises an immobilized oligonucleotide and is also referred to herein as a probe. The calculation of the DNA methylation on the basis of the ratio was carried out according to the equation: methylation=(intensity probe S_M)/((intensity probe S_M)+(intensity probe S_U)). Afterwards, the methylation values determined for each of the five loci with the sequences SEQ ID NO:20, SEQ ID NO:21, SEQ ID NO:22, SEQ ID NO:23 and SEQ ID NO:24 were arithmetically averaged. Patients were then retrospectively divided into two groups based on their known prognosis using the methylation value thus determined, resulting in a PDCD1 gene locus methylation threshold of 57.5%. One group had a methylation of the PDCD1 gene locus below the threshold of 57.5% and is in the following referred to as the group with low PDCD1 methylation. Accordingly, the group that exhibited a methylation above 57.5% of the PDCD1 gene locus is hereinafter referred to as the group with high PDCD1 methylation.

FIG. 1 shows that it is possible to divide the patients into two groups according to the method of the present invention, of which the patients in the group with low PDCD1 methylation have a significantly better prognosis than the patients in the group with high PDCD1 methylation, whereby the prognosis is defined here exemplarily by the expected time until the occurrence of a biochemical relapse, i.e. an increase in the blood parameter PSA specific for prostate cancer. The group with low PDCD1 methylation showed a mean PSA relapse-free survival of 92 months, whereas the group of patients with high PDCD1 methylation showed a 13-month shorter PSA relapse-free survival with an average of 79 months. The application of the method according to the present invention thus made it possible to divide patients into different risk groups for a PSA relapse.

It is therefore possible to determine the prognosis of a patient whose tumor has just been removed and whose disease course in the future is not yet known. For this purpose, the DNA methylation of the PDCD1 gene in the tumor of this patient can be determined using the Infinium Human Methylation450 BeadChip. If, for example, said methylation is below the threshold value of 57.5%, then this patient can be assigned to the group of patients with the better prognosis with an average of 92 months relapse-free survival. If, for example, the methylation of the PDCD1 gene in the tumor of a patient is above the threshold value, the PSA relapse is likely to occur earlier in this patient. This patient could then benefit from an additional adjuvant therapy. For example, it might be advisable to monitor the follow-up of this patient more closely in order to be able to diagnose the recurrence of PSA earlier so that suitable treatment measures can be initiated.

Example 2: Determination of the Prognosis of a Patient with Prostate Cancer after Radical Ectomy Using DNA Methylation Analysis of the Immunoregulatory Gene CD274

According to another embodiment of the method of the present invention, it is also possible to determine the prognosis of a patient with malignant disease using the DNA methylation analysis of CpG dinucleotides within the CD274 gene. For example, the prognosis of a patient with localized prostate cancer can be determined analyzing the methylation of the CD274 gene in the tumor after the patient has undergone radical removal (radical ectomy) of the prostate and the tumor in the prostate.

Tumor samples from a total of 417 patients with known prognosis were retrospectively examined. The DNA methylation analysis was carried out as described in example 1. The five bead pairs cg15837913, cg02823866, cg14305799, cg13474877, and cg19724470 were used to calculate the relative methylation of the CD274 gene locus from the raw data of the Infinium Human Methylation450 BeadChip, which enable CpG dinucleotide methylation analysis of the genomic sequences SEQ ID NO:8, SEQ ID NO:9, SEQ ID NO:10, SEQ ID NO:11, and SEQ ID NO:12. As described in Example 1 for the PDCD1 gene, a relative methylation level was calculated for each of the five pairs of beads for each patient by correlating the beads specific for the unmethylated state and the beads specific for the methylated state of each pair as described in Example 1. These five methylation values were then averaged to result in a relative methylation value per patient sample. Patients were subsequently divided into two groups based on the methylation value thus determined and depending on their retrospectively established prognosis, resulting in a threshold of 52.75% relative methylation at the CD274 gene locus. A group of 337 patients had a methylation in the CD274 gene locus below the 52.75% threshold and is hereinafter referred to as the group with low CD274 methylation. Accordingly, the group that exhibited a methylation higher than 52.75% in the CD274 gene locus is referred to as the group with high CD274 methylation. This group consisted of 80 patients.

Figure 2A:
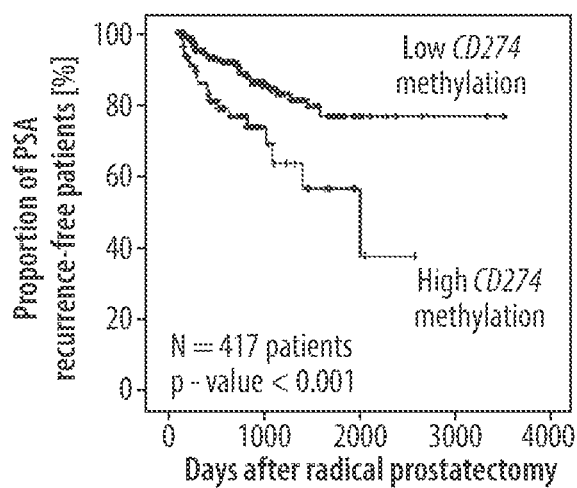
FIG. 2 shows the Kaplan-Meier analysis of relapse-free survival of 417 (A) or an independent cohort of 259 (B) prostate cancer patients after radical prostatectomy. Patients are stratified by DNA methylation analysis of the CD274 gene locus in the tumor according to the present invention. DNA methylation analysis was performed using Infinium Human Methylation450 BeadChip technology (A) or quantitative methylation-specific real-time PCR (B).

FIG. 2A shows that it is possible to divide the patients into two groups by using the method according to the present invention, wherein the group with low CD274 methylation has a significantly better prognosis than the group with high CD274 methylation. In this exemplary application, the prognosis is defined as the expected time to biochemical recurrence, i.e. an increase in the prostate cancer-specific blood parameter PSA. The group with low CD274 methylation showed an average PSA relapse-free survival of 2,822 days, while the group with high PDCD1 methylation showed a by 1,244 days reduced average PSA relapse-free survival of 1,578 days. The method of the present invention thus made it possible to stratify the patients according to different risk groups for PSA relapse.

It is also possible to carry out the DNA methylation analysis by real-time PCR in order to determine the prognosis of patients with malignant diseases according to the present invention. In this example, 259 patients with prostate tumors and known prognosis were examined retrospectively. The patient cohort was different from the previously described 417 patients.

For the DNA methylation analysis using real-time PCR, tissue sections with a thickness of 10 µm were prepared and mounted on glass slides. Using a HE section, the tumor areas were identified by pathological examination. These tumor areas were then scraped off the glass slides with a scalpel. Bisulfite-converted DNA from the tumor areas was prepared with the innuCONVERT Bisulfite All-In-One Kit (Analytik Jena, Jena, Germany) according to the manufacturer's instructions. The amount of converted DNA was then quantified using a NanoDrop ND-1000 spectrophotometer (Thermo Fisher Scientific, Waltham, Mass., USA). The DNA methylation analysis of the prostate tumors was carried out by methylation-specific amplification and quantification of the CD274 gene locus using quantitative real-time PCR (qPCR). A duplex or multiplex PCR was used, in which both methylation and total DNA were determined within the same reaction. The determination of total DNA can be accomplished, for example, by using primers and probes whose target sequence does not contain CpG dinucleotides and whose target sequence is thus amplified independently of methylation. In the present example, a locus in the ACTB gene has been amplified for the determination of total DNA. This locus has the sequence SEQ ID NO:32 in the genome and after conversion by bisulfite has the sequence SEQ ID NO:7. This sequence was amplified using the primers of SEQ ID NO:4 and SEQ ID NO:5. Sequence-specific detection of the amplicon was accomplished with the probe of the sequence SEQ ID NO:6, which carried the fluorescent dye Atto 647N at 5' and the quencher BHQ-2 at 3'. The methylation-specific amplification of the CD274 locus was achieved with primers having the sequences SEQ ID NO:13 and SEQ ID NO:14. These primers amplify the sequence resulting from bisulfite conversion of the sequence SEQ ID NO:33. In the case of complete methylation, this converted region in the genome has the sequence SEQ ID NO:16. In case of complete methylation, this transformed region in the genome has the sequence SEQ ID NO:16. The methylation-specific detection was accomplished with a probe of the sequence SEQ ID NO:15, which carried the fluorescent dye 6-FAM at 5' and the quencher BHQ-1 at 3'. The methylation state of the converted DNA of the prostate tumors was calculated using the ΔΔCT method and expressed as percentage compared to a standard DNA with 100% methylation. The standard DNA used was artificially methylated DNA (CpGenome™ Universal Methylated DNA; Merck Millipore, Darmstadt, Germany), which was previously converted with the innuCONVERT Bisulfite All-In-One Kit according to the manufacturer's instructions. In this example, the real-time PCR quantification of CD274 methylation was carried out in 20 µl PCR reactions using three independent measurements each, using the following reaction composition: 35 mM Tris-HCl, pH 8.4, 6 mM MgCl$_2$, 50 mM KCl, 4% glycerol, 0.25 mM each dNTP (dTTP, dATP, dGTP, dCTP), 2 U FastStart Taq DNA polymerase (Roche Applied Science, Penzberg, Germany), 0.4 µM of each primer and 0.2 µM of each detection probe. For example, qPCR was performed using an AB 7500 Fast Real-Time PCR system (Life Technologies Corporation, Carlsbad, Calif., USA). A suitable temperature profile included for instance the following steps: 20 min at 95° C. followed by 45 cycles of 45 s each at 56° C. and 15 s at 95° C.

Figure 2B:
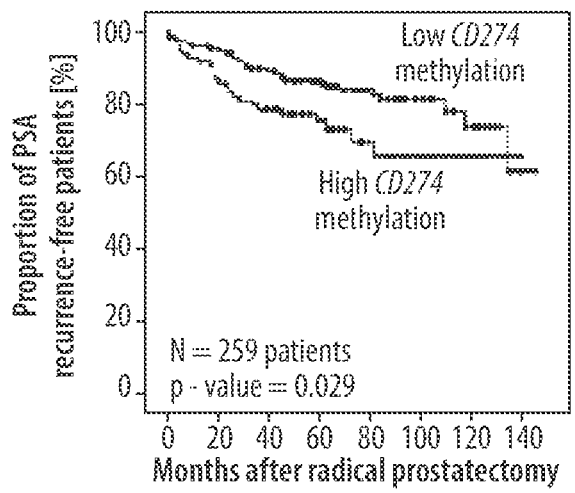

FIG. 2B shows that the method of the present invention is suitable for determining the prognosis of patients with prostate carcinomas by means of determining the methylation of the CD274 gene locus using real-time PCR. It was possible to divide the 259 patients into two groups with different prognosis based on the DNA methylation analysis. Patients whose tumors showed methylation above 0.975% had an average PSA relapse-free survival of 93 months, while patients whose tumors showed methylation below 0.975% exhibited a 21 months longer average PSA relapse-free survival (114 months).

For example, it is possible to determine the methylation of the CD274 locus in the tumor sample of a patient with unknown prognosis analogously to the real-time PCR described above. If this methylation is above 0.975%, for example, the patient may have an unfavorable prognosis, which may be an average of 93 months of relapse-free survival. However, if said methylation in the tumor is below this threshold, the patient is likely to have a more favorable prognosis with an average of 114 months relapse-free survival.

In this example, the method of the present invention was carried out using two different technologies, real-time PCR and Infinium Human Methylation450 BeadChip. The methylation threshold, which was used to group patients into a group with good prognosis and a group with poor prognosis, was 52.75% (Infinium Human Methylation450 BeadChip) and 0.975% (real-time PCR). It is clear to the skilled person that suitable thresholds for classification into prognostic groups can be determined depending on the method used for the DNA methylation analysis. Another possibility is to calibrate different methods with each other so that the results of the respective DNA methylation analysis can be compared directly. For example, calibration can be performed by DNA methylation analysis of one or more standard DNA samples with defined percentage of methylation using different methods. By relating the results of each DNA methylation analysis from the immunoregulatory genes to be examined to the results of the DNA methylation analysis from the standard DNA samples for each method, the measurement results can be calibrated so that the calibrated measurement results from different methods can be compared.

Example 3: Determination of Prognosis of Patients with Malignant Melanoma by DNA Methylation Analysis of the Immunoregulatory Genes PDCD1, PDCD1LG2 and CD274

This example demonstrates the determination of the prognosis of 470 patients with malignant melanoma according to the present invention. The results of the DNA methylation analysis were generated using the Infinium Human Methylation450 BeadChip as described in Example 1. To determine the relative methylation level of the respective gene, a relative methylation level was first determined for each selected pair of beads of the Infinium Human Methylation450 BeadChip as described in Example 1. This relative methylation level of up to six bead pairs per gene was then averaged to obtain a representative methylation value for the respective gene. The bead pairs cg15837913 (SEQ ID NO:8), cg02823866 (SEQ ID NO:9), cg14305799 (SEQ ID NO:10), cg13474877 (SEQ ID NO:11) and cg19724470 (SEQ ID NO:12) were used for the methylation analysis of CD274. These beads allow for, the determination of methylation of CpG dinucleotides in the sequence regions SEQ ID NO:1, SEQ ID NO:33 and SEQ ID NO:76 of the CD274 gene, for example. The bead pairs cg00795812 (SEQ ID NO:20), cg03889044 (SEQ ID NO:22), cg17322655 (SEQ ID NO:23), cg20805133 (SEQ ID NO:24) and cg27051683 (SEQ ID NO:369) were used for the methylation analysis of PDCD1. These beads enable, for example, the determination of methylation of CpG dinucleotides in the sequence regions SEQ ID NO:3 and SEQ ID NO:29 of the PDCD1 gene. The bead pair cg07211259 (SEQ ID NO:31) was used for the methylation analysis of PDCD1LG2. This bead enables, for example, the determination of the methylation of CpG dinucleotides of the sequence region SEQ ID NO:84 of the PDCD1LG2 gene.

Figure 3A:
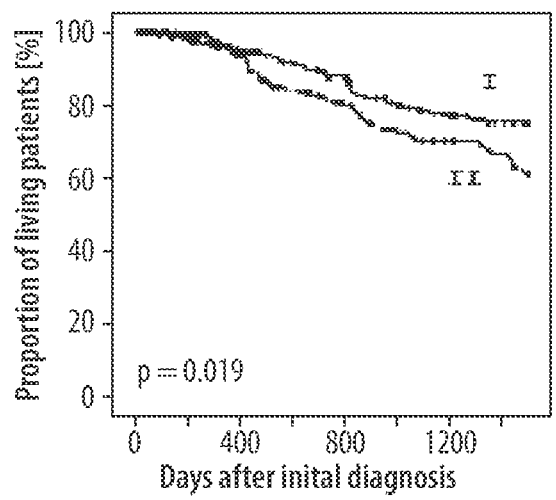
FIG. 3 shows the Kaplan-Meier analysis of overall survival of 470 patients with malignant melanoma stratified by DNA methylation analysis of the immunoregulatory genes PDCD1 (A), CD274 (B) and PDCD1LG2 (C) in the tumor. Group I: Patients with DNA methylation in the tumor below the threshold. Group II: Patients with DNA methylation in the tumor above the threshold. The thresholds for patient grouping were 12.84% for PDCD1LG2, 13.11% for CD274, and 20.54% for PDCD1.
Figure 3B:
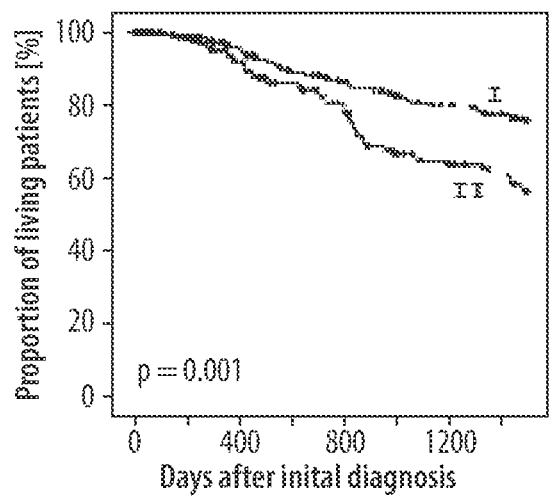
Figure 3C:
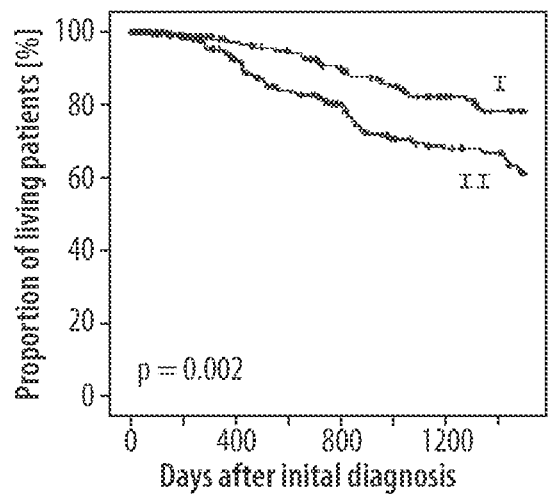
Figure 4A:
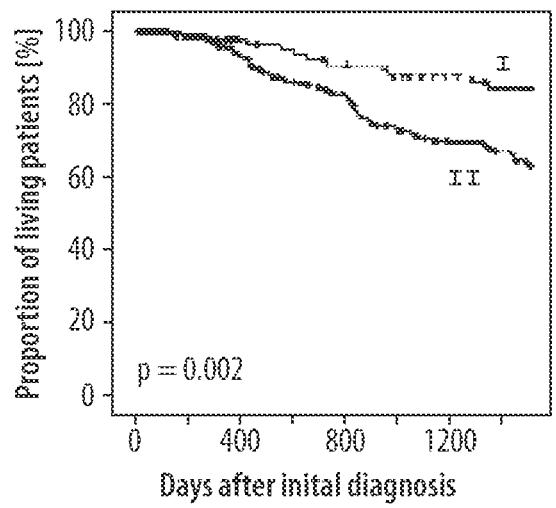
FIG. 4 shows the Kaplan-Meier analysis of overall survival of 470 patients with malignant melanomas stratified by DNA methylation analysis of the immunoregulatory genes TIGIT (A), TNFRSF9 (B), LAG3 (C), BTLA (D), CTLA4 (E) and CD40 (F). Group I: Patients with methylation in the tumor below the threshold. Group II: Patients with methylation in the tumor above the threshold. The thresholds for patient grouping were 86.41% for TIGIT, 57.80% for TNFRSF9, 66.94% for LAG3, 91.31% for BTLA, 13.10% for CTLA4 and 17.16% for CD40.
Figure 4B:
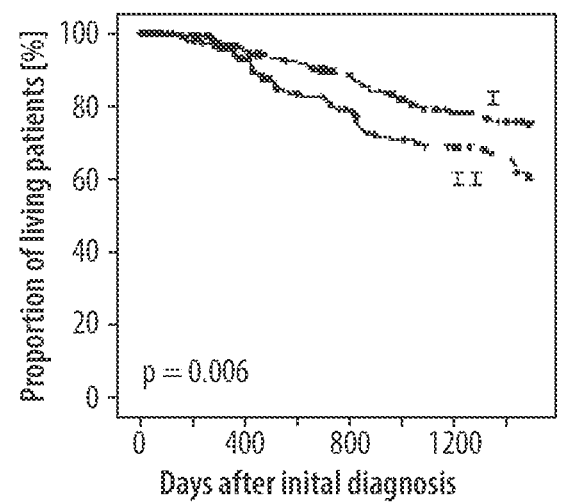
Figure 4C:
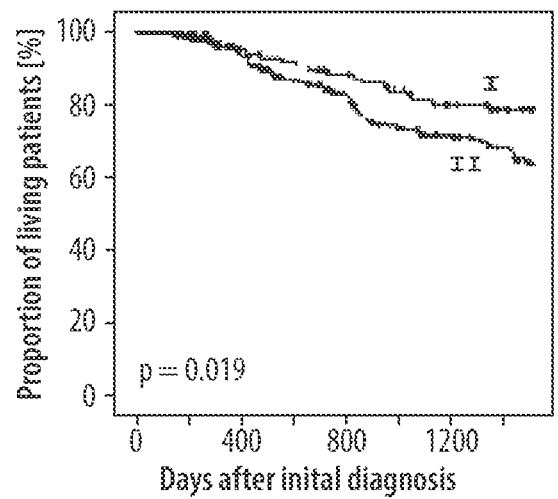
Figure 4D:
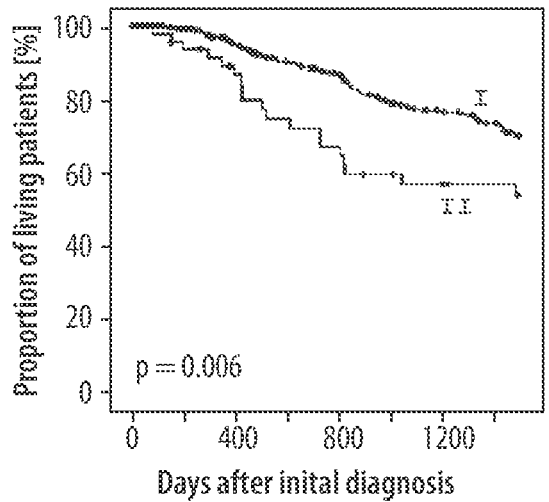
Figure 4E:
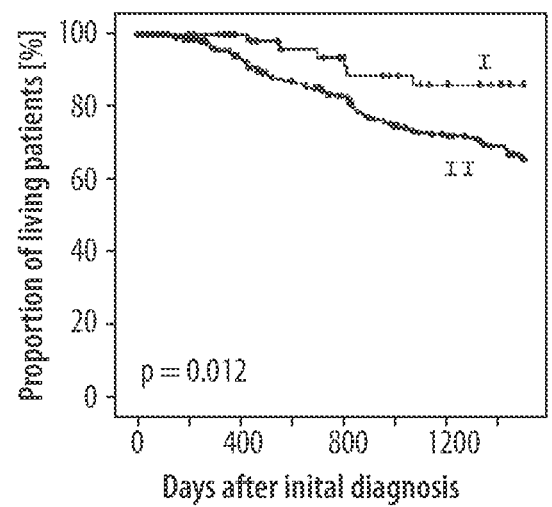
Figure 4F:
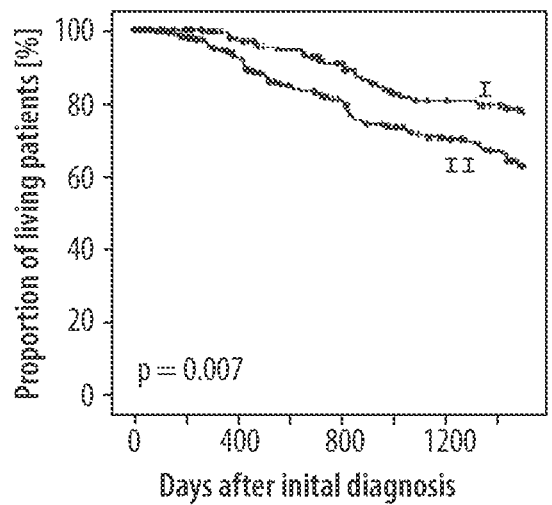

FIG. 3 depicts the retrospective stratification of the 470 patients with malignant melanoma into prognostic groups based on the DNA methylation analyses. The Kaplan-Meier survival analyses of patients who were divided into groups based on the methylation of the genes PDCD1 (FIG. 3A), CD274 (FIG. 3B) and PDCDILG2 (FIG. 3C) in the tumor depending on their prognosis are shown. Group I comprises patients whose tumor exhibited low methylation below a threshold value in the corresponding gene locus. Group II contains those patients whose tumor showed increased methylation above the threshold of the respective gene. For example, the following methylation thresholds were defined for the grouping of patients: 12.84% for PDCD1LG2, 13.11% for CD274 and 20.54% for PDCD1. For all three genes analyzed, it was possible to establish using the DNA methylation analysis that patients with elevated methylation in the tumor showed an unfavorable course of the disease. The use of the method in accordance with the invention thus made it possible to determine prognosis groups of patients with malignant melanomas on the basis of DNA methylation of the immune checkpoint gene PDCD1 and the gene CD274 encoding the corresponding ligand. It was also demonstrated that PDCD1LG2, another gene coding for a ligand of the immune checkpoint PDCD1, could be used to determine the prognosis according to the present invention.

This example shows that the method of the present invention is not limited to a single malignant disease, prostate carcinoma, as in Example 1 and Example 2, but that it is also possible to determine the prognosis for other malignant diseases, such as malignant melanoma. The determination of the prognosis using DNA methylation analysis of these genes is therefore not limited to individual entities but can be applied to other malignancies. Thus, this invention overcomes the problem of a limited applicability of conventional prognostic methods to specific entities.

Furthermore, it could be shown in this example that the method of the present invention allows to determine the prognosis with regard to different health conditions in the future. In Example 1 and Example 2 the occurrence of a PSA relapse could be predicted correctly. A PSA relapse is a characteristic that is limited to prostate tumors. In the present Example 3, however, the event of the patient's death could be predicted.

Example 4: Determination of Prognosis of Patients with Malignant Melanoma by DNA Methylation Analysis of the Immunoregulatory Genes TIGIT, TNFRSF9, LAG3, BTLA, CTLA4 and CD40

The method of the present invention also allows for the prognosis of patients with malignant melanoma to be assessed on the basis of methylation of the immune checkpoint genes TIGIT, TNFRSF9, LAG3, BTLA, CTLA4 and CD40. In this example, the results of the DNA methylation analysis for the determination of the relative methylation level of the genes were generated using the Infinium Human Methylation450 BeadChip (Illumina, Inc., San Diego, Calif., USA) as described in Example 1. Afterwards, a relative methylation level was determined for each of the genes TIGIT, TNFRSF9, LAG3, BTLA, CTLA4 and CD40. As described in Example 1, for each a pair of beads a ratio of the beads specific for the methylated and unmethylated state was formed. The bead pairs cg24157392 and cg19281794 were used for the BTLA gene. These beads bind to the sequence of the human DNA, which had the sequence SEQ ID NO:37 or SEQ ID NO:37 prior to bisulfite conversion, and thus enable, for example, the determination of methylation of the sequence region SEQ ID NO:276. Both pairs of beads each consist of one pair of beads, one of which binds to the sequence unmethylated prior to bisulfite conversion and one of which binds to the sequence methylated prior to conversion. The ratio was formed from these two bead pairs, as shown below for the bead pair cg24157392: methylation=(intensity cg24157392_M)/((intensity cg24157392_M)+(intensity cg24157392_U)), wherein cg24157392_M is the bead that binds to the methylated variant and cg24157392_U is the bead that binds to the unmethylated variant. The same procedure was used for the bead pair cg19281794. The relative methylation value for BTLA was then calculated by arithmetically averaging the relative methylation of the bead pairs cg24157392 and cg19281794.

The relative methylation of the genes TIGIT, TNFRSF9, LAG3, BTLA, CTLA4 and CD40 was determined accordingly. For the determination of the relative methylation of TNFRSF9, the bead pairs cg14614416 (SEQ ID NO:51), cg14153654 (SEQ ID NO:54), cg17123655 (SEQ ID NO:55), cg18025409 (SEQ ID NO:57), cg06956444 (SEQ ID NO:58) and cg08840010 (SEQ ID NO:59) were used, which for instance permit the determination of methylation of the sequence regions SEQ ID NO:308, SEQ ID NO:309 and SEQ ID NO:321 in the genome. The bead pairs cg19785066 (SEQ ID NO:47), cg09053081 (SEQ ID NO:48) and cg21601405 (SEQ ID NO:49) were used for the determination of the methylation of CD40, which are for instance suitable to determine the methylation of the sequence regions SEQ ID NO:297 and SEQ ID NO:298. Bead pairs cg02771886 (SEQ ID NO:61), cg08723913 (SEQ ID NO:62), cg17164827 (SEQ ID NO:63), cg04885775 (SEQ ID NO:64), cg23637607 (SEQ ID NO:65) and cg16358924 (SEQ ID NO:66) were used to determine the methylation of TIGIT, which are suitable for determining methylation of the sequence region SEQ ID NO:267. The bead pair cg08460026 (SEQ ID NO:39) was used to determine the methylation of the sequence region SEQ ID NO:162 of the CTLA4 gene. The bead pairs cg04153135 (SEQ ID NO:40), cg20652042 (SEQ ID NO:41) and cg01820374 (SEQ ID NO:42) were used to determine the relative methylation of LAG3. These bead pairs are suitable for determining methylation in the sequence regions SEQ ID NO:161, SEQ ID NO:349 and SEQ ID NO:351.

FIG. 4 shows the retrospective stratification of the 470 patients with malignant melanoma into prognosis groups based on the DNA methylation analyses in accordance with the invention. The Kaplan-Meier survival analyses of patients who were divided into groups based on the methylation of the genes TIGIT (FIG. 4A), TNFRSF9 (FIG. 4B), LAG3 (FIG. 4C), BTLA (FIG. 4D), CTLA4 (FIG. 4E) and CD40 (FIG. 4F) in the tumor are shown. Group I includes patients whose tumor exhibited low methylation below a threshold in the corresponding gene locus. Group II contains those patients whose tumor showed increased methylation above the threshold value of the respective gene. For example, the following methylation levels were defined as thresholds for patient grouping: 86.41% for TIGIT, 57.80% for TNFRSF9, 66.94% for LAG3, 91.31% for BTLA, 13.10% for CTLA4 and 17.16% for CD40. For all immunoregulatory genes studied in this example, it was demonstrated that patients with tumors with elevated methylation above the threshold showed a significantly more severe clinical course of the disease than patients with tumors with methylation below the threshold.

Example 5: Determination of the Prognosis of Patients with Squamous Cell Carcinoma of the Head and Neck Using DNA Methylation Analysis of the Immunoregulatory Gene PDCD1

Figure 5:
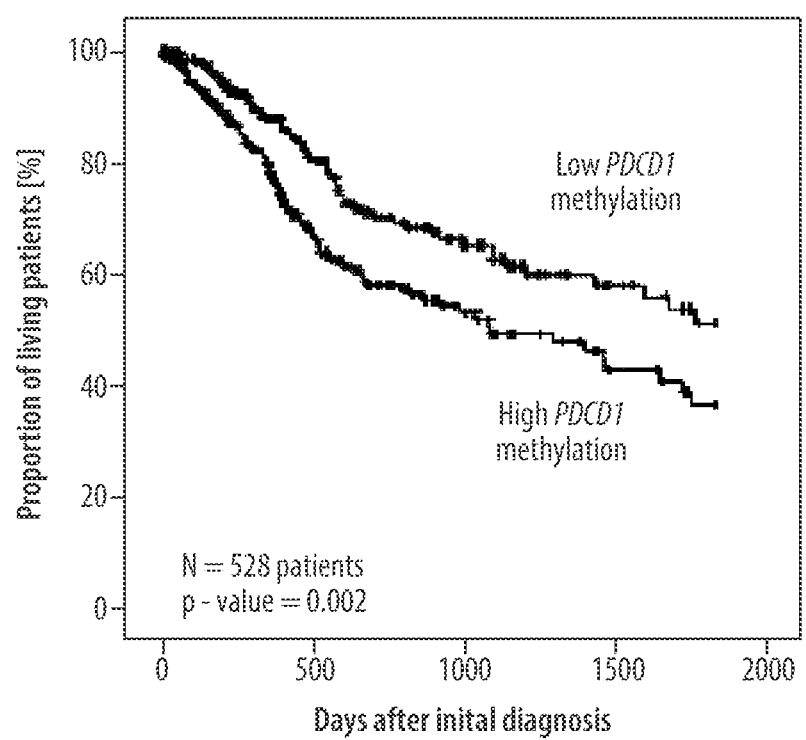
FIG. 5 shows the Kaplan-Meier analysis of overall survival of 528 patients with squamous cell carcinomas of the head and neck stratified by DNA methylation analysis of the PDCD1 gene locus. Patients were grouped according to the median methylation of all patients, with patients with methylation above the median assigned to one group and patients with methylation below the median assigned to the other group.
Figure 6A:
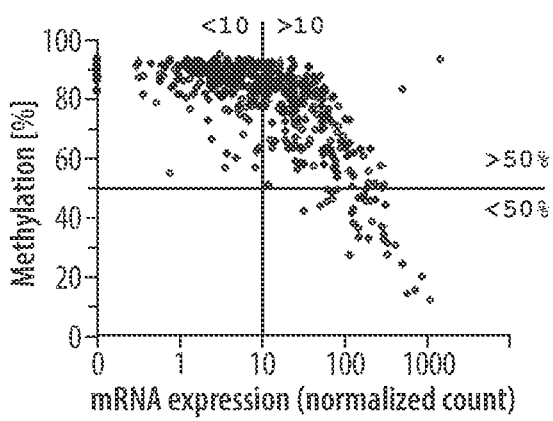
FIG. 6 shows the correlation of DNA methylation analysis and mRNA expression analysis of the BTLA (A) and CD27 (C) genes for the investigation of 470 patients with malignant melanomas as well as the results of the Kaplan-Meier analysis of overall survival of the patients stratified by the mRNA expression of the BTLA (B) and CD27 (D) genes.
Figure 6B:
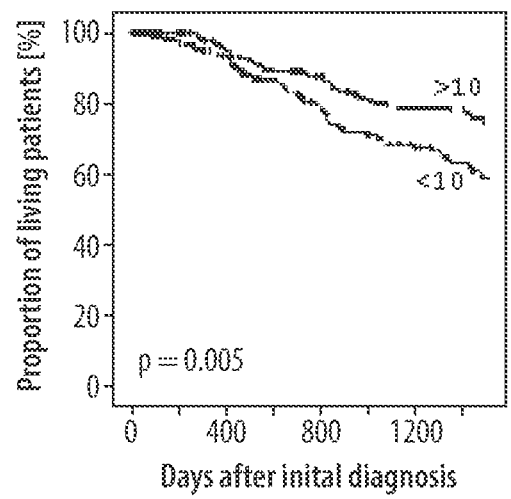
Figure 6C:
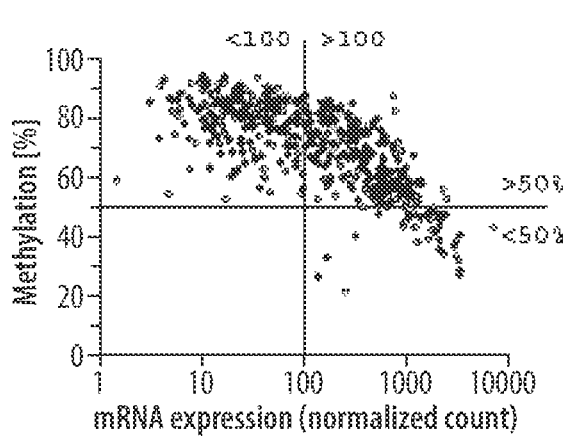
Figure 6D:
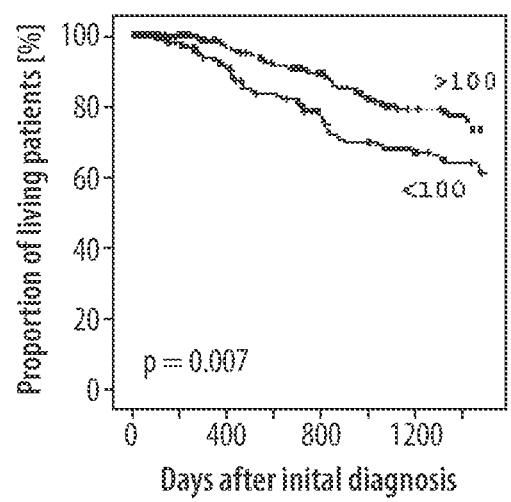

FIG. 5 shows the retrospective stratification of 528 patients with squamous cell carcinomas of the head and neck area into prognosis groups using the method in accordance with the present invention. Death is defined as the clinical endpoint. The DNA methylation analysis of the immune checkpoint gene PDCD1 was carried out with DNA from tumor tissue. Patients with high PDCD1 methylation showed a more severe course of disease than patients with low methylation of the PDCD1 gene locus. The patients were grouped by dichotomization using the median as the threshold value, i.e. the threshold value was chosen so that one half (n=264 patients) of the patient samples had a methylation value above the threshold value and the other half (n=264 patients) had a methylation value below the threshold value.

It was also possible to perform the DNA methylation analysis of PDCD1 by real-time PCR. Suitable conditions and compositions for the real-time PCR correspond to those of Example 2. The following oligonucleotides were used for PCR: SEQ ID NO:25 (forward primer), SEQ ID NO:26 (reverse primer) and SEQ ID NO:27 (detection probe). The detection probe was labeled with FAM and BHQ-1. The primers used allow for the amplification of the bisulfite converted DNA with the sequence SEQ ID NO:368. This sequence had the sequence SEQ ID NO:367 before the bisulfite conversion. Tumor samples from a total of 120 patients with squamous cell carcinoma of the head and neck area and known outcome were retrospectively examined. Patients were divided into a group of 40 patients with low methylation and a group of 80 patients with high methylation based on the DNA methylation analysis and their prognosis. The group of patients with high methylation exhibited significantly worse overall survival compared to the group with low methylation (p-value<0.05).

In Example 1 it was demonstrated that the method of the present invention allows for the prognosis of patients with prostate cancer to be determined from the methylation of the PDCD1 gene. These prostate carcinomas were carcinomas that originated from the glandular epithelium of the prostate gland. These carcinomas therefore belong to the group of adenocarcinomas. In Example 3 it was demonstrated that the method of the present invention also allows to assess the prognosis of patients with malignant melanomas. Melanomas do not belong to carcinomas, since they do not originate from epithelial cells but from melanocytes. Melanomas therefore represent a fundamentally different malignant disease compared to carcinomas. In the present Example 5, it was additionally demonstrated that it is also possible to determine the prognosis of patients with squamous cell carcinomas of the head and neck area in accordance with the present invention. Like adenocarcinomas, these squamous cell carcinomas belong to carcinomas, i.e. they originate from epithelial cells. In contrast to adenocarcinomas, however, squamous cell carcinomas do not originate from the glandular epithelium but from the squamous epithelium. Thus, it could be shown that the method according to the present invention is not only capable of determining the prognosis of carcinomas of different origins, but also of malignant diseases that are not carcinomas. These results additionally prove the universal applicability of the method of the present invention for assessing prognosis and/or prediction in various malignant diseases.

Example 6: Determination of mRNA Expression of Immune Checkpoint Genes Using DNA Methylation Analysis The method of the present invention also allows for the determination of the expression of the immune checkpoints encoded by the immunoregulatory genes, as exemplarily shown in the following for the mRNA expression of the BTLA and CD27 genes.

The mRNA can be determined, for example, after extraction of the mRNA, preparation of a cDNA library of the total RNA and a subsequent Next Generation Sequencing based analysis. For instance, the RNA can be obtained from tumor tissue using the RNeasy Mini Kit (Qiagen, Hilden) according to the manufacturer's instructions. Then, for example, a library can be prepared using the TruSeq RNA Library Preparation Kit v2 (Illumina) according to the manufacturer's instructions and be analyzed using the HiSeq PE (Paired-End) Cluster Kit v4 cBot (Illumina) on a HiSeq 2500 Next Generation Sequencer (Illumina). The measurement of the mRNA and the determination of the proportion of mRNA molecules of a specific sequence in relation to the amount of total mRNA molecules was performed as described by the TCGA Research Network.

FIG. 6 shows the correlation of DNA methylation with mRNA expression for BTLA (FIG. 6A) and CD27 (FIG. 6C) in the tissue of malignant melanomas of 470 patients. It is evident that all tumors with a methylation of the respective loci below 50% showed an expression of mRNA above 10 (BTLA, FIG. 6A) and above 100 (CD27, FIG. 6C), respectively. FIG. 6B shows that melanoma patients whose tumors exhibited a BTLA mRNA expression of >10 have a significantly better prognosis than patients whose tumors exhibited a lower mRNA expression. Analogous to BTLA, FIG. 6D shows that melanoma patients whose tumors had a CD27 mRNA expression of >100 had a significantly better prognosis than patients whose tumors had a lower mRNA expression.

The expression of the BTLA and CD27 genes can not only be used to determine the patient's prognosis, but is also indicative of the likelihood of a response to therapy, for example if the therapy is directed against the corresponding gene product. This example shows that the methylation of the gene loci in the tumor allows for the determination of the mRNA expression and can be used to assess the patient's prognosis. Firstly, this solves the problem that a direct determination of mRNA is often hampered by the low stability of mRNA in clinical routine. Furthermore, this example shows that by determining the prognosis of the patient using the DNA methylation analysis, it is also possible to simultaneously evaluate the expression of the immunoregulatory gene analysed. In this way, the patient can be classified for a therapy which, depending on the expression of the gene product, i.e. the immune checkpoint, is likely to be effective or is unlikely to be effective. Therapies directed directly against the immune checkpoint or its interaction partner are particularly suitable for this purpose. Particularly suitable are immunotherapies with monoclonal antibodies directed against these gene products.

Example 7: Determination of the Prognosis of a Patient with a Malignant Melanoma Using Combined DNA Methylation Analysis and mRNA Expression Analysis A DNA methylation analysis and mRNA expression analysis of the CD274 gene in tumors of 470 patients with malignant melanoma and known prognosis were performed. The determination of mRNA expression and DNA methylation was done as described in Examples 1, 3 and 6.

Figure 7A:
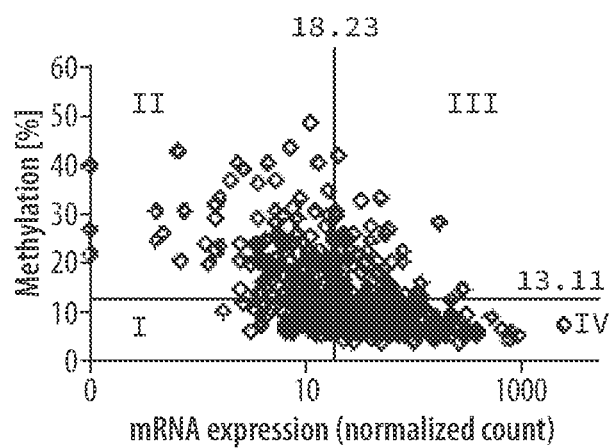
FIG. 7 shows the correlation of mRNA expression analysis and DNA methylation analysis of the immunoregulatory gene CD274 (A) for the investigation of 470 patients with malignant melanomas, as well as the Kaplan-Meier analysis of overall survival of the patients stratified using the DNA methylation analysis (B), the mRNA expression analysis (C) and the combination of mRNA expression analysis and DNA methylation analysis (D).
Figure 7B:
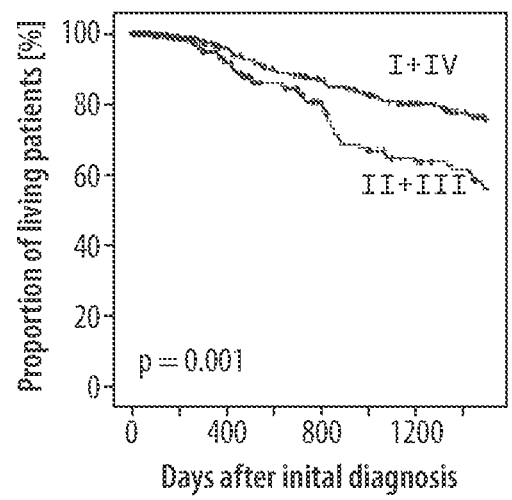
Figure 7C:
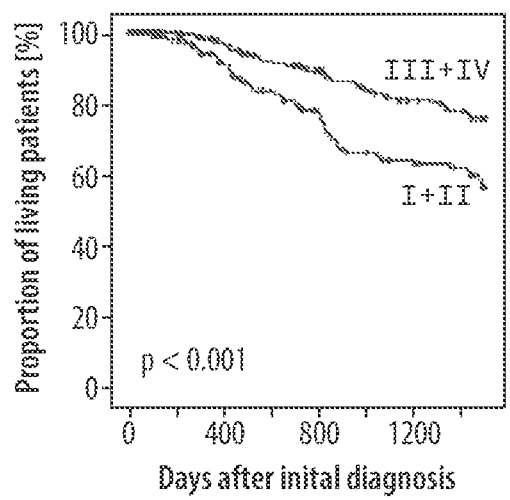
Figure 7D:
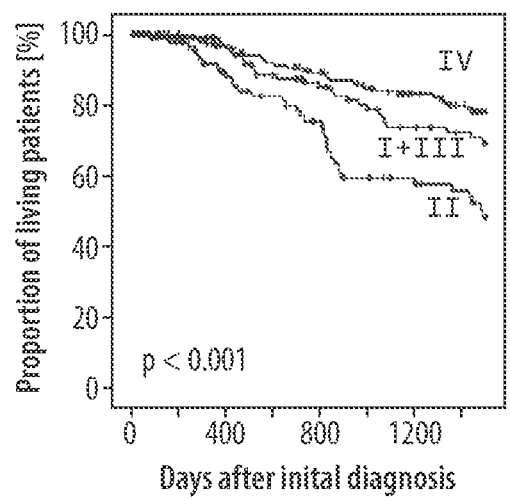

FIG. 7A shows a scatter plot of the determined mRNA expression and DNA methylation of the CD274 gene with drawn-in threshold values, on the basis of which the retrospective classification into prognostic groups with high and low mRNA expression or DNA methylation, respectively, was conducted. FIG. 7A shows the significantly negative correlation (Spearman's $\rho=-0.546$, $p<0.001$) between DNA methylation and mRNA expression. Based on the introduced threshold value for methylation at 13.11%, the patients can be divided into a group with higher (group II+III) and with lower DNA methylation (group I+IV) in accordance with the present invention. Similarly, the introduction of a vertical threshold value for mRNA expression at 18.23 as shown in FIG. 7A allows for the differentiation of two groups with high (group III+IV) and low (group I+II) mRNA expression. FIG. 7B shows a Kaplan-Meier analysis of overall survival of patients with high CD274 methylation in the tumor (group II+III) compared to patients with low methylation (group I+IV). Patients in group II+III exhibited a less favorable prognosis compared to patients in group I+IV. FIG. 7C illustrates the Kaplan-Meier analysis of overall survival of patients with high CD274 mRNA expression in the tumor (group III+IV) compared to patients with low expression (group I+II). Patients whose tumors show an increased mRNA expression of the gene CD274 in the tumor (group III+IV) have a more favorable clinical course of disease compared to patients from group I+II whose tumors showed a lower mRNA expression of CD274. FIG. 7D shows the Kaplan-Meier analysis of overall survival of patients with high CD274 mRNA expression and low methylation in the tumor (group IV) compared to patients with high methylation and low mRNA expression (group II) and patients with high methylation and high mRNA expression and patients with low methylation and low mRNA expression (group I+III). It is evident that patients who are assigned to the group with the good prognosis on the basis of both mRNA expression analysis and DNA methylation analysis (group IV: high mRNA expression and low methylation) have a significantly more favorable clinical course of disease compared to patients whose tumors are assigned to the group with the poor prognosis on the basis of mRNA expression analysis and DNA methylation analysis (group II: high methylation and low expression). All other patients (Group I+III) show a prognosis between the prognosis of Groups II and IV (FIG. 7D).

Figure 8A:
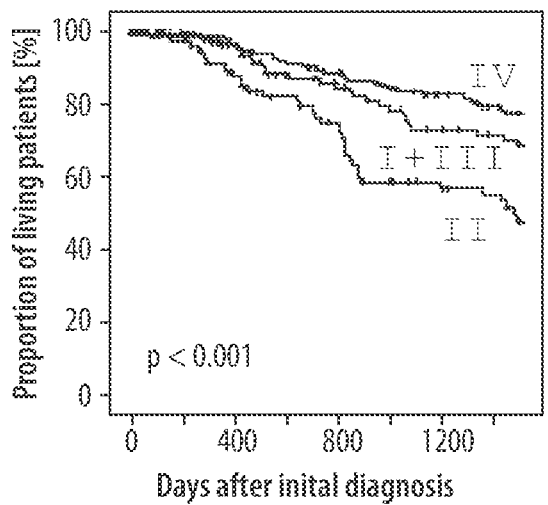
FIG. 8 shows the Kaplan-Meier analysis of overall survival of 470 patients with malignant melanoma, stratified by DNA methylation analysis according to the present invention and mRNA expression analysis of the immunoregulatory genes CD274 (A) (as in FIG. 7), PDCD1LG2 (B), PDCD1 (C), BTLA (D), LAG3 (E), TIGIT (F), CD40 (G), CTLA4 (H) and TNFRSF9 (I). Group II (high risk group): high DNA methylation and low mRNA expression; Group IV (low risk group): low methylation and high mRNA expression; Group I+III (medium risk group): high mRNA expression and high DNA methylation or low mRNA expression and low DNA methylation.
Figure 8B:
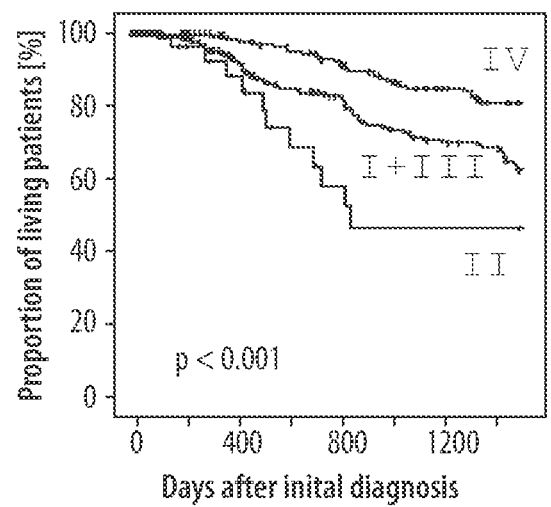
Figure 8C:
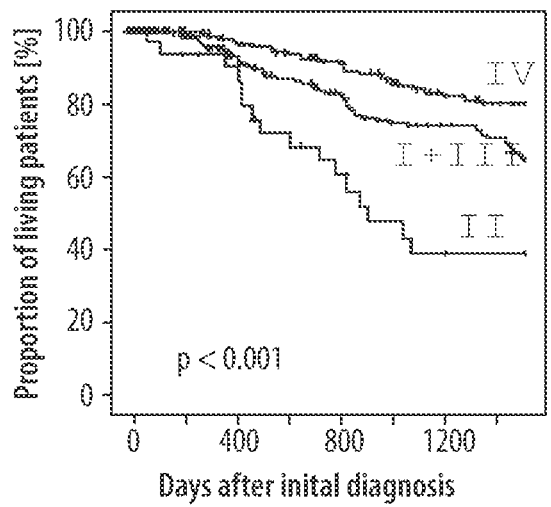
Figure 8D:
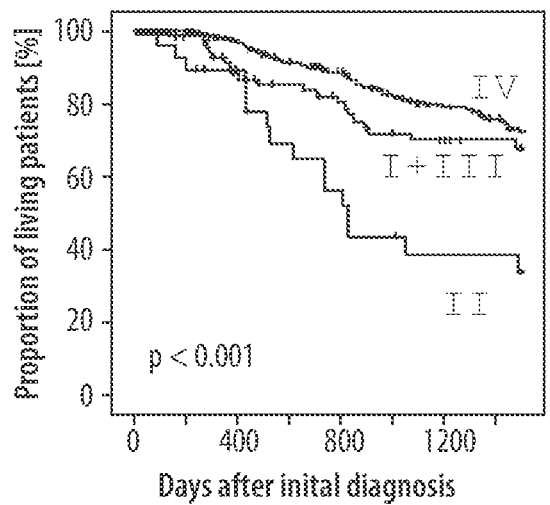
Figure 8E:
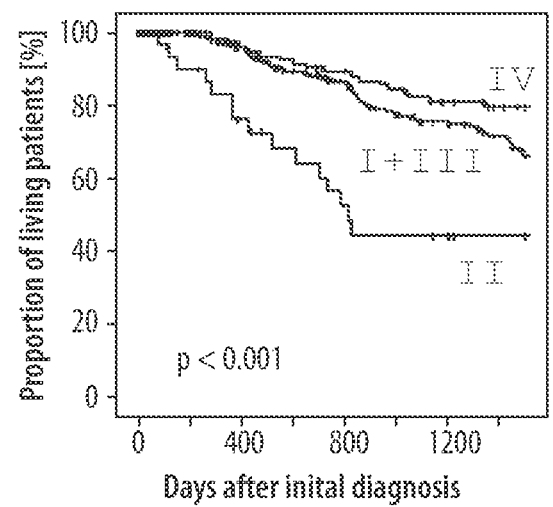
Figure 8F:
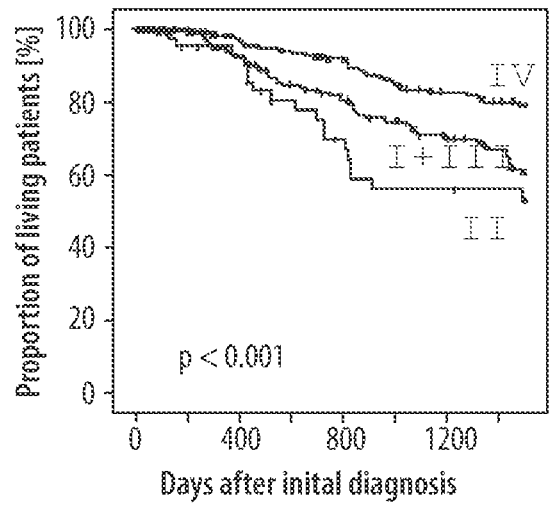
Figure 8G:
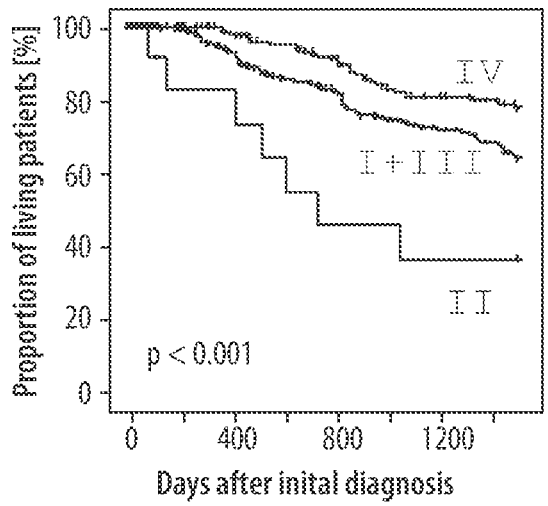
Figure 8H:
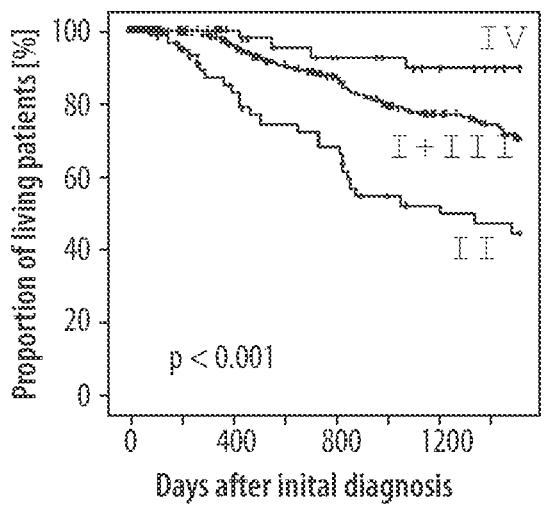
Figure 8I:
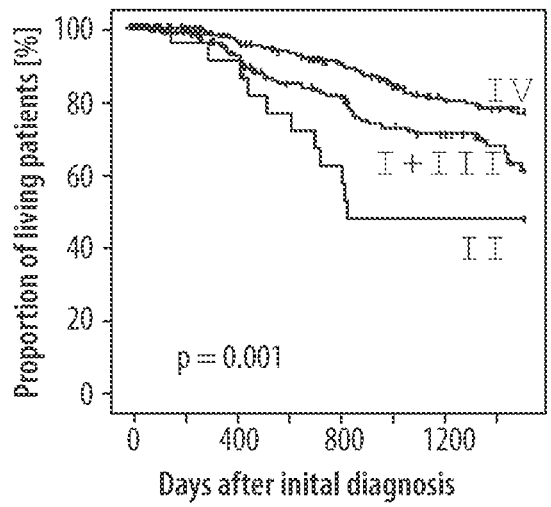

FIG. 7 illustrates in detail an embodiment of the invention-based method with regard to the combination of mRNA expression analysis and DNA methylation analysis for improved determination of the prognosis of a patient with a malignant melanoma using the gene CD274 as an example. This embodiment of the present invention also enables an improved assessment of prognosis when applied to other genes. In addition to CD274 (FIG. 8A and FIG. 7D) this could also be demonstrated for the genes PDCD1LG2 (FIG. 8B), PDCD1 (FIG. 8C), BTLA (FIG. 8D), LAG3 (FIG. 8E), TIGIT (FIG. 8F), CD40 (FIG. 8G), CTLA4 (FIG. 8H) and TNFRSF9 (FIG. 8I). FIG. 8 shows the retrospective stratification of 470 patients with malignant melanoma and known prognosis using the combined analysis of mRNA expression and DNA methylation of different immunoregulatory genes in accordance with the present invention. Patients were grouped according to threshold values that were individually defined for the genes like in FIG. 7. The clinical courses of disease of patients with high DNA methylation and low mRNA expression in the tumor (group II), patients with low DNA methylation and high mRNA expression in the tumor (group IV), as well as the remaining patients (group I+III) were compared. For all analyzed genes it could be shown that group II had an unfavourable course of disease and group IV a favourable course of disease, while the remaining patients (group I+III) had a medium risk of death. Group II thus represents a high-risk group and group IV a low-risk group.

Example 8: Determining the Prognosis of a Patient with a Malignant Melanoma Using Combined DNA Methylation Analysis and mRNA Expression Analysis of the Immunoregulatory Genes PDCD1LG2, CD274, PDCD1, BTLA, LAG3, TIGIT, CD40, CTLA4 and TNFRSF9

Figure 9A:
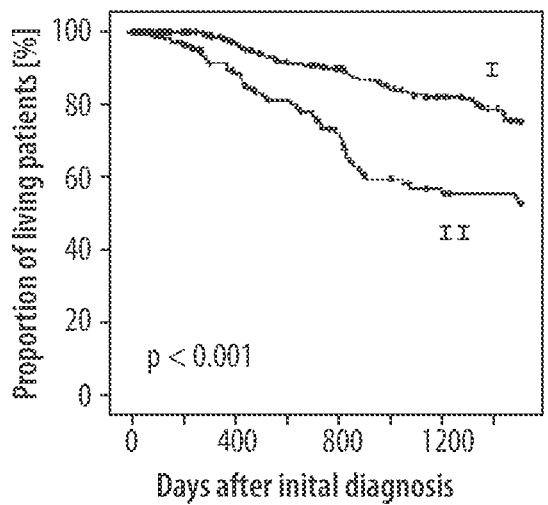
FIG. 9 shows the Kaplan-Meier analysis of overall survival of 470 patients with malignant melanoma, stratified according to the present invention by mRNA expression analysis (A), DNA methylation analysis (B) and combined mRNA expression analysis and DNA methylation analysis (C) of the nine immunoregulatory genes CD274, PDCD1, PDCD1LG2, TIGIT, TNFRSF9, LAG3, BTLA, CTLA4 and CD40. Group I: Patients with increased mRNA expression in at least eight of the nine genes; Group II: Patients with increased mRNA expression in less than eight of the nine genes; Group III: Patients with increased DNA methylation in no more than four of the nine genes; Group IV: Patients with increased DNA methylation in at least five of the nine genes; Group V: Patients belonging to both Group I and III; Group VI: Patients belonging to both Group II and Group IV; Group VII: Patients belonging to either Groups I and IV or Groups II and III.
Figure 9B:
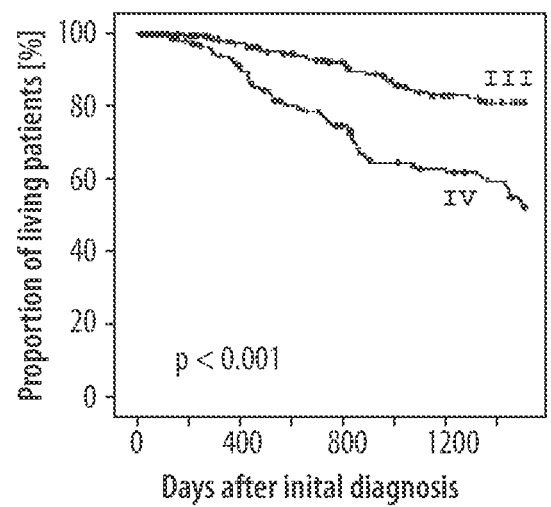

In Examples 3 and 4 the determination of the prognosis of patients with malignant melanoma by DNA methylation analysis of nine different immune checkpoint genes (PDCD1LG2, CD274, PDCD1, BTLA, LAG3, TIGIT, CD40, CTLA4 and TNFRSF9) in accordance with the present invention was demonstrated. The determination of the prognosis of patients with malignant disease can be further improved by combining DNA methylation analysis and mRNA expression analysis of different genes. The determination of mRNA expression and DNA methylation was carried out as described in Examples 1 and 6. A quantitative methylation value was calculated for each gene as described in Examples 3 and 4. The patients were initially stratified into prognostic groups based on the mRNA expression of the nine genes. Group I is the group to which a favorable prognosis could be assigned on the basis of the mRNA expression of the nine genes. Group I comprises patients whose tumor showed increased mRNA expression above the threshold of at least eight of the nine genes. Group II is the group to which an unfavorable prognosis could be assigned on the basis of the mRNA expression of the nine genes. Group II included those patients whose tumors exhibited mRNA expression above the threshold in less than eight of the nine genes analyzed. Subsequently, patients were stratified according to the DNA methylation of the nine genes. Group III is the group to which a favorable prognosis could be assigned on the basis of DNA methylation of the nine genes. Group III comprises patients whose tumor shows increased DNA methylation above the threshold in a maximum of four of the nine genes. Group IV is the group to which an unfavorable prognosis could be assigned on the basis of DNA methylation of the nine genes. Group IV included those patients whose tumors showed methylation above the threshold in at least five of the nine genes analyzed. Finally, the stratification of patients was done according to the DNA methylation and mRNA expression of the nine genes. Group V comprised the patients who could be assigned to the groups with the favorable prognosis based on both mRNA expression and DNA methylation. Group V included patients who were in both group I and group III. Group VI included the patients in the groups with unfavorable prognosis as indicated by both mRNA expression and DNA methylation. Group VI included the patients who were in both group II and group IV. Group VII Included those patients who were in the group with the favorable prognosis according to either mRNA expression or DNA methylation. Group VII included the patients who were in both group I and group IV or both group II and group III. FIG. 9B shows that those patients who, based on the DNA methylation of a maximum of four of the nine genes analyzed, were each assigned to a group with a poorer prognosis, i.e. exhibited methylation above the threshold value for the respective gene, had overall a very favorable prognosis (group III). Patients who, on the basis of methylation analysis, can be assigned to a group with a poorer prognosis according to at least five of the nine genes (group IV), also had a significantly less favorable prognosis overall. FIG. 9A shows that patients who were assigned to the group with the more favorable prognosis according to the mRNA expression analysis of at least eight of the nine genes (group I) had overall a significantly more favorable prognosis than patients who were assigned to the group with the good prognosis according to the mRNA expression analysis of less than eight of the nine genes in (group II). For example, the following methylation thresholds were defined for the stratification of patients using the DNA methylation analysis: 12.84% for PDCD1LG2, 13.11% for CD274, 20.54% for PDCD1, 86.41% for TIGIT, 57.80% for TNFRSF9, 66.94% for LAG3, 91.31% for BTLA, 13.10% for CTLA4 and 17.16% for CD40. The mRNA expression thresholds for patient grouping by mRNA expression analysis were for instance 5.61 for PDCD1LG2, 18.23 for CD274, 7.29 for PDCD1, 12.38 for TIGIT, 0.935 for TNFRSF9, 9.65 for LAG3, 3.33 for BTLA, 13.12 for CTLA4, and 30.14 for CD40.

Figure 9C:
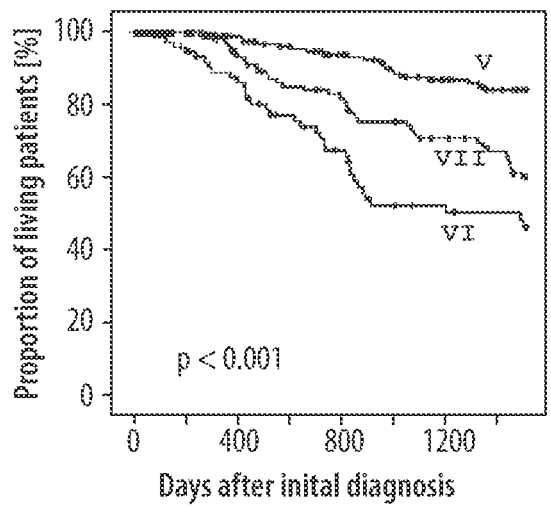

In Example 7 (FIG. 8), it has already been demonstrated that the combination of DNA methylation analysis and mRNA expression analysis according to the present invention allows for an even more differentiated determination of the prognosis of patients with malignant disease than the determination of the prognosis using either DNA methylation analysis or mRNA expression analysis alone. This advantageous effect of the present invention can therefore be further improved, as shown here, if the combination of DNA methylation analysis and mRNA expression analysis comprises several immunoregulatory genes. FIG. 9C shows that patients whose tumors are classified in the groups with a good prognosis (FIG. 9B, group III and FIG. 9A, group I) according to both the DNA methylation analysis and the mRNA expression analysis of the nine genes examined here have a very good prognosis overall (FIG. 9C, Group V). Patients, who were in each case classified in the group with the bad prognosis (FIG. 9 C, group VI) both on the basis of the DNA methylation analysis and on the basis of the mRNA expression analysis of the here examined nine genes exhibited an unfavorable prognosis. All other patients (FIG. 9C, Group VII) exhibited a clinical course of disease that was more favorable than that of Group VI and less favorable than that of Group V.

Example 9: Determination of the Prognosis of a Patient with a Malignant Melanoma on the Basis of Promoter Methylation and Intragenic Methylation of the Immunoregulatory Genes CD40 and LAG3

It is a common assumption that DNA methylation of a gene correlates inversely with mRNA expression. This means that high methylation of the gene is associated with low mRNA expression of the gene. In this exemplary embodiment of the present invention, it could however be shown that in intragenic regions a significant positive correlation can also occur. This was shown exemplarily using the genes LAG3 and CD40. The determination of mRNA expression and DNA methylation was performed as described in Examples 1 and 6. The relative methylation level of the promoters of the two genes LAG3 and CD40 was calculated as described in Example 4. For the determination of the methylation of the intragenic regions, the following bead pairs were used and put in relation to each other as described in Example 1 in order to obtain a relative methylation value for each gene locus. The bead pairs cg11429292 (SEQ ID NO:43) and cg14292870 (SEQ ID NO:44) were used for the intragenic DNA methylation analysis of LAG3, which, for example, allow for DNA methylation analysis in the regions with SEQ ID NO:161 and SEQ ID NO:350. For the intragenic DNA methylation analysis of CD40, the bead pair cg06218285 (SEQ ID NO:50) was used, which, for example, allows for DNA methylation analysis in the region SEQ ID NO:297.

FIG. 10 shows the result of the assessment of the prognosis of 470 patients with malignant melanomas in accordance with the invention. The stratification of the patients was done retrospectively on the basis of the methylation analysis of the promoter and intragenic regions, evaluated both individually as well as in combination. FIG. 10A and FIG. 10O show that the relative methylation of CpG dinucleotides located in the promoter region is negatively correlated with the mRNA expression of the corresponding gene. Additionally, it could be shown that the relative methylation of the intragenic regions of these genes is positively and significantly correlated with the mRNA expression (FIG. 10B and FIG. 10D). FIGS. 10E and 10H depict the results for DNA methylation analysis of the genes LAG3 and CD40 that were already shown in Example 4.

Figure 10A:
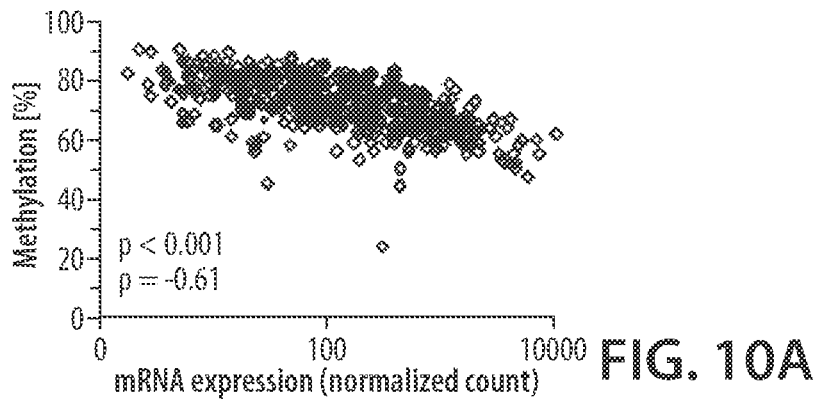
FIG. 10 shows the correlation of mRNA expression with DNA methylation of the promoter region (A) and the intragenic region (B) for the immunoregulatory gene LAG3; the correlation of mRNA expression with DNA methylation of the promoter region (C) and the intragenic region (D) for the immunoregulatory gene CD40; as well as the Kaplan-Meier analysis of overall survival of 470 patients with malignant melanomas, stratified according to the present invention by DNA methylation analysis of the promoter (E, H), the intragenic region (F, I) and the combined analysis of both regions (G, J) of the immunoregulatory genes LAG3
Figure 10B:
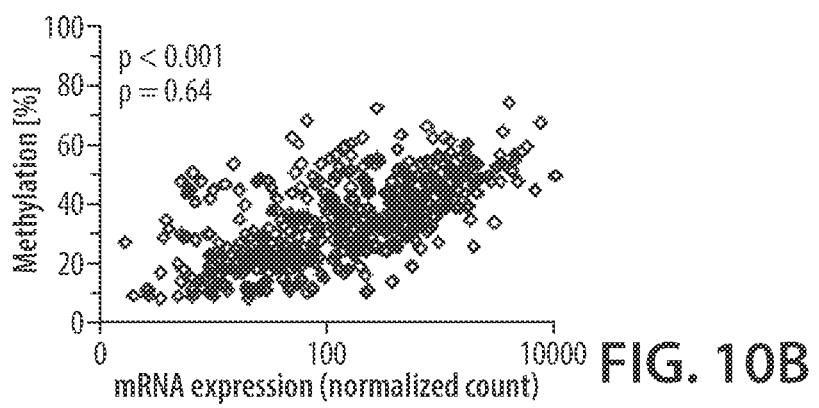
Figure 10C:
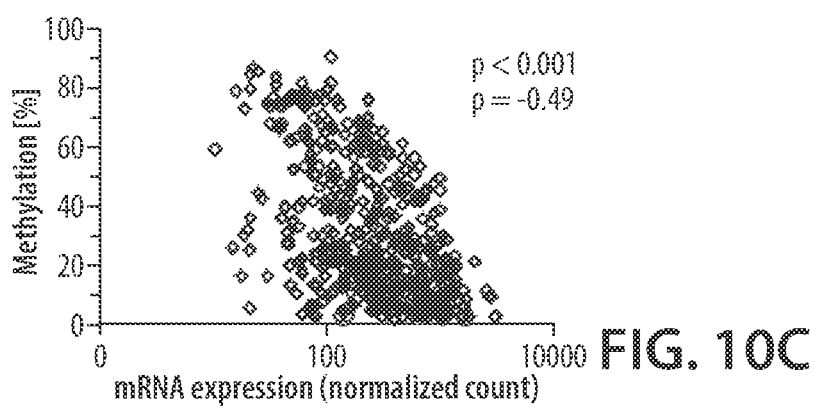
Figure 10D:
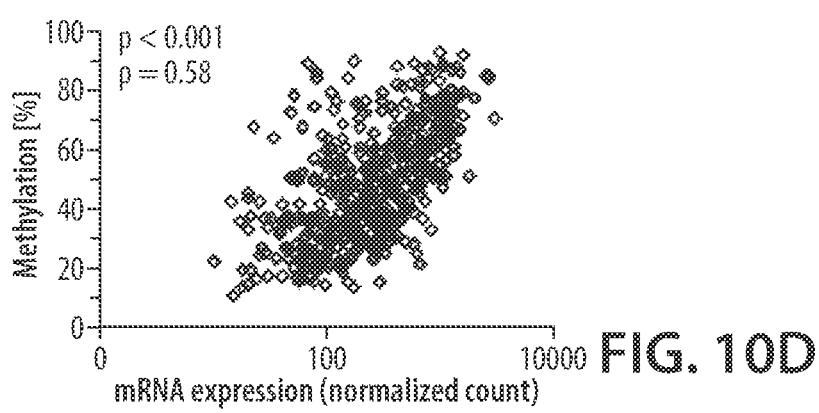
Figure 10E:
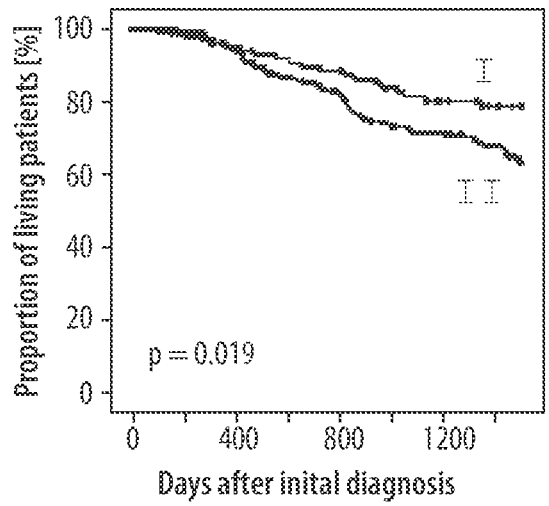
Figure 10F:
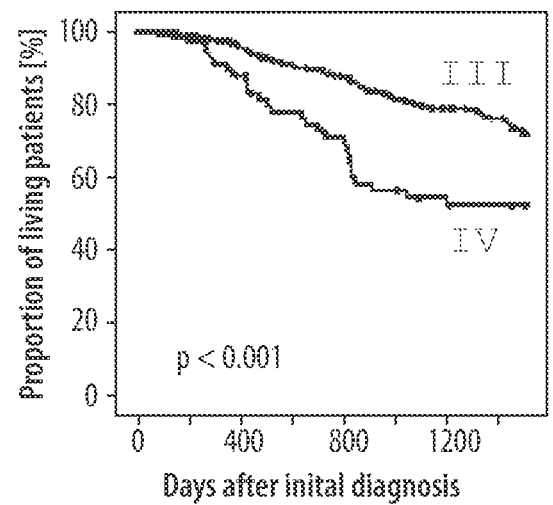
Figure 10G:
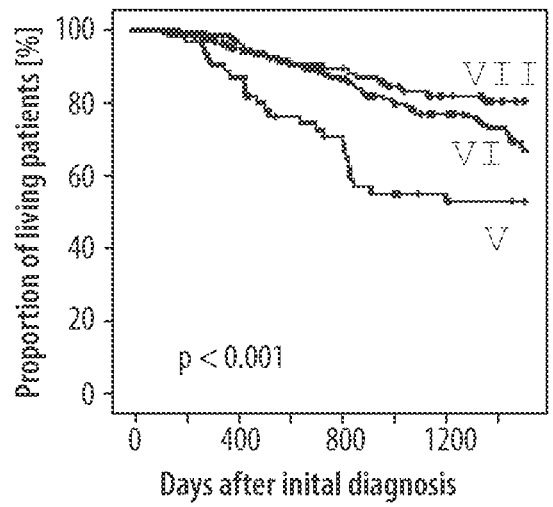
Figure 10H:
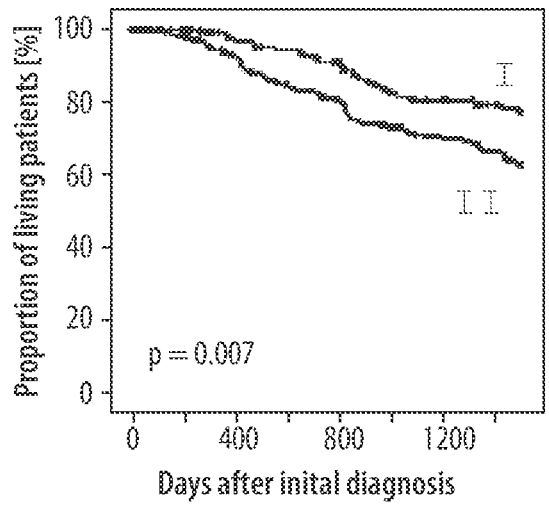
Figure 10I:
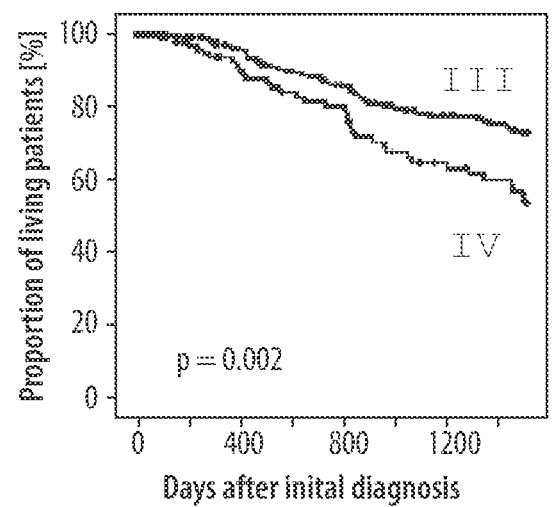
Figure 10J:
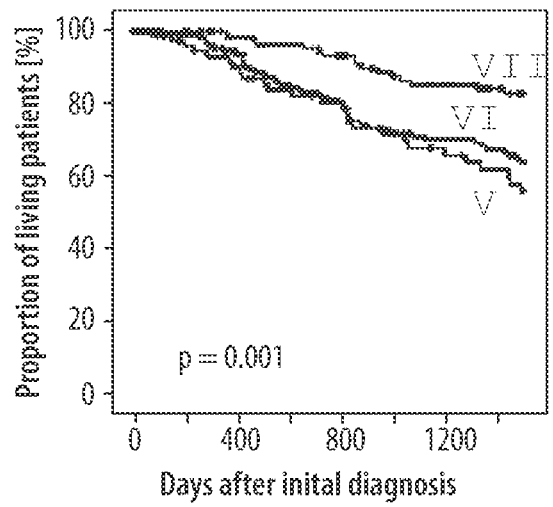

Those patients with increased DNA methylation (group II) in the LAG3 and CD40 promoter exhibit an unfavorable course of disease (FIGS. 10E and 10H). These conditions are surprisingly reversed in the intragenic region. Group III in FIG. 10F comprises those patients whose tumors revealed intragenic methylation of the LAG3 gene above 20.67%. Group IV includes those patients whose tumors displayed methylation below 20.67%. Patients with decreased intragenic methylation of the LAG3 gene exhibited an unfavorable course of disease. The Kaplan-Meier survival analysis of the patients' disease progression in relation to the combined intragenic and promoter methylation of the LAG3 gene led to an improved prognosis determination (FIG. 10G). Group V includes those patients who are in both group II and group IV. Group VII comprises those patients who are in both group I and group III. Group VI includes the patients who are either in groups II and III or in I and IV. The patients who had an unfavorable prognosis according to both the intragenic methylation and the promoter methylation of the LAG3 gene formed a group with a particularly unfavorable course of disease (FIG. 10G, Group V).

The Kaplan-Meier survival analysis of the disease course of the patients in relation to the promoter and intragenic methylation of the CD40 gene as well as the combined evaluation of both analyses (FIG. 10H, 10I, 10J) led to similar results as those obtained with LAG3. Group I (FIG. 10H) includes those patients whose tumors exhibited methylation below 17.16%. Group II included those patients whose tumors revealed methylation above 17.16% (FIG. 10H). Those patients with increased methylation in the CD40 promoter had an unfavorable course of disease. Group III (FIG. 10I) includes those patients whose tumors revealed methylation above 35%. Group IV (FIG. 10I) includes those patients whose tumors showed methylation above 35%. Patients with reduced intragenic methylation of the CD40 gene showed an unfavorable course of disease. Group V (FIG. 10J) comprises those patients who are in both group II and group IV. Group VII (FIG. 10J) comprises those patients who are in both group I and group III. Group VI includes those patients who are either in groups II and III or I and IV. It could be demonstrated that the patients who were in the groups with a good prognosis based on DNA methylation analysis of the CD40 promoter as well as the intragenic region now formed a group with a particularly good prognosis. Thus, the combined DNA methylation analysis of the promoter and the intragenic region of the CD40 gene improved the determination of the prognosis compared to the individual analyses in terms of a more differentiated risk assessment.

Example 10: Determination of Prognosis of Patients with Acute Myeloid Leukaemia by DNA Methylation Analysis and mRNA Expression Analysis of CD274, PDCD1 and PDCD1LG2

The method of the present invention also allows to determine the prognosis of patients with malignant haematological diseases. The mRNA expression analysis and DNA methylation analysis of malignant cells of 182 patients with acute myeloid leukaemia was carried out as described in Examples 1 and 6. Based on the results of DNA methylation analysis, the relative DNA methylation level of the genes CD274, PDCD1 and PDCD1LG2 was calculated as described in Example 3.

FIG. 11 shows the Kaplan-Meier analyses of overall survival of the 182 patients with acute myeloid leukaemia.

Figure 11A:
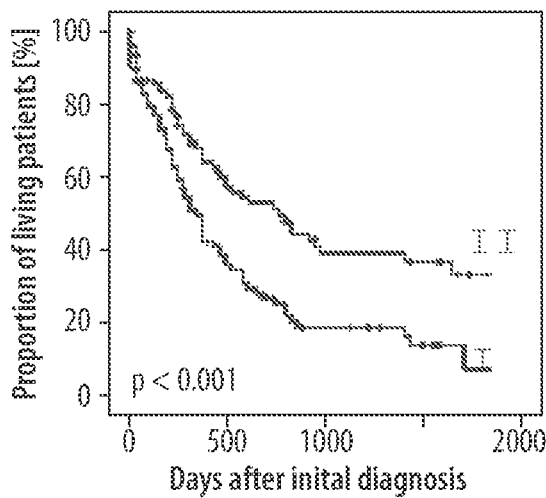
Figure 11B:
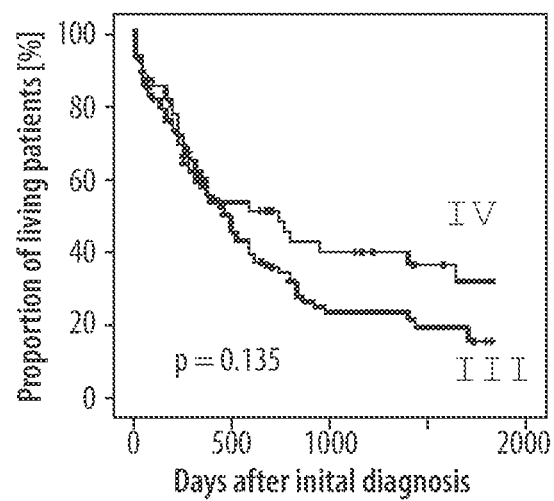
Figure 11C:
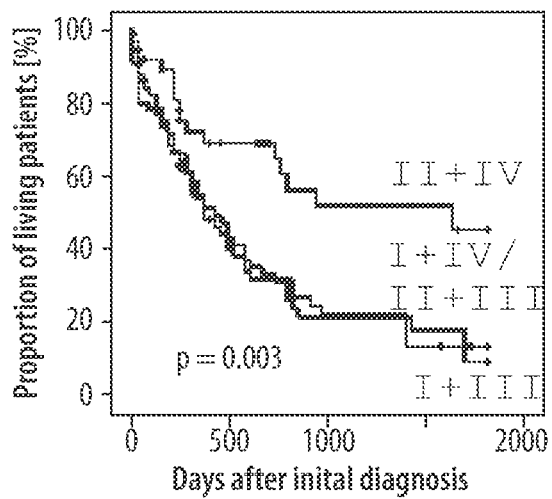
Figure 11D:
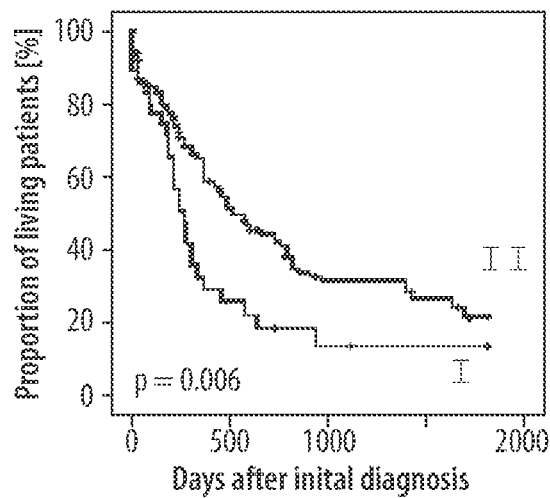
Figure 11E:
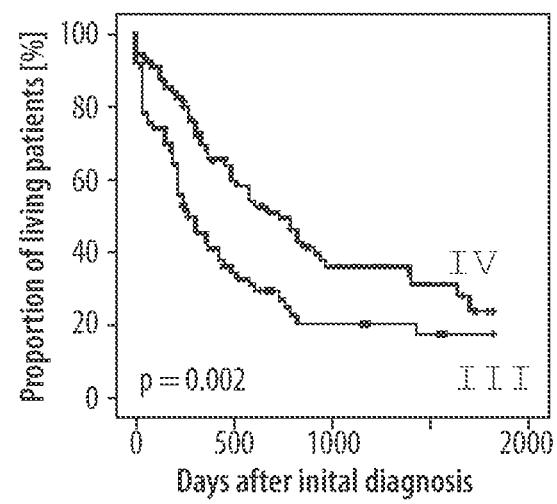
Figure 11F:
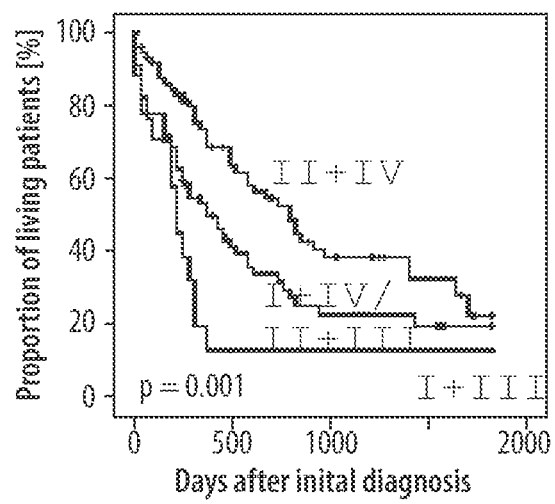
Figure 11G:
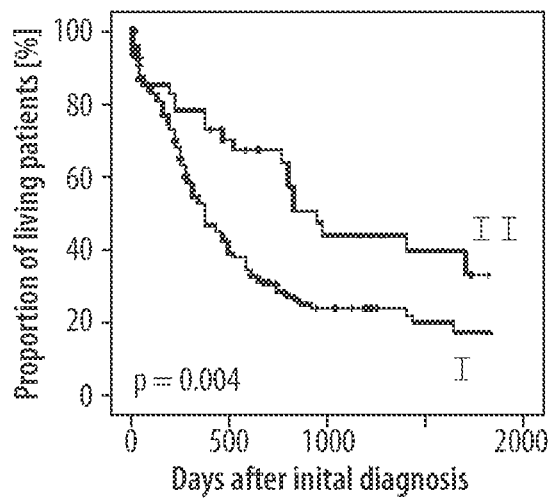
Figure 11H:
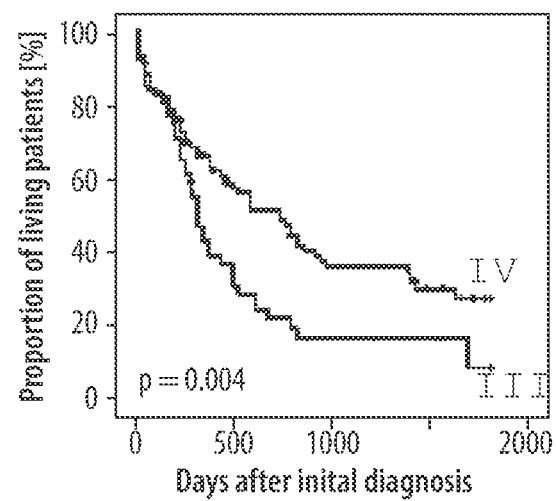
Figure 11I:
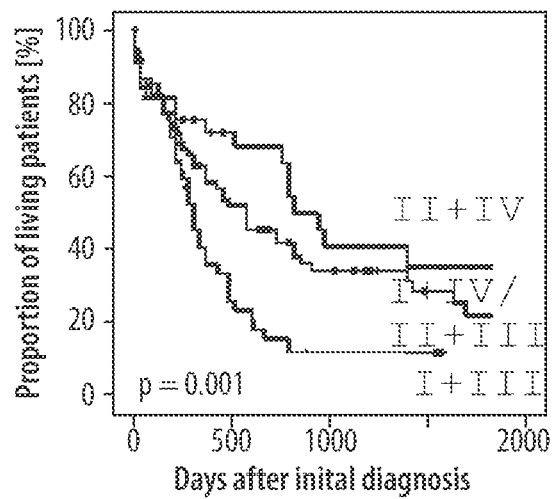
Figure 12A:
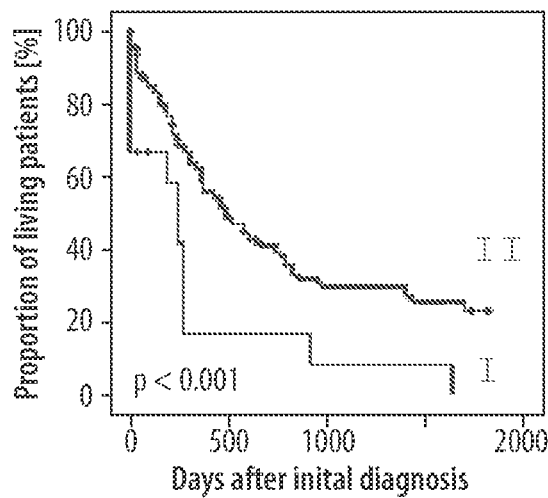
Figure 12B:
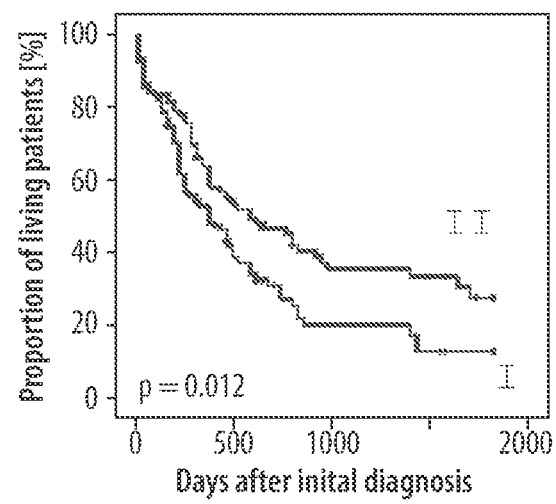
Figure 12C:
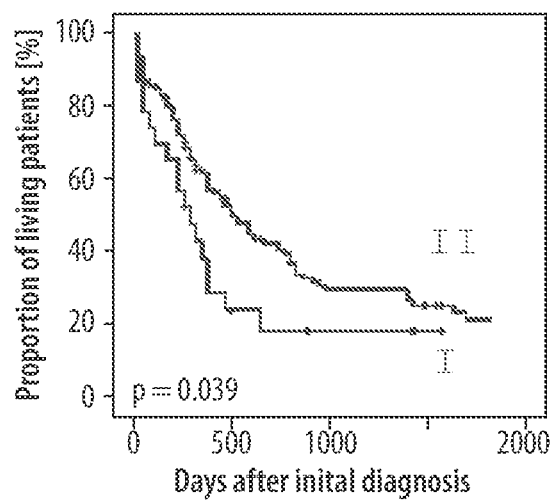
Figure 12D:
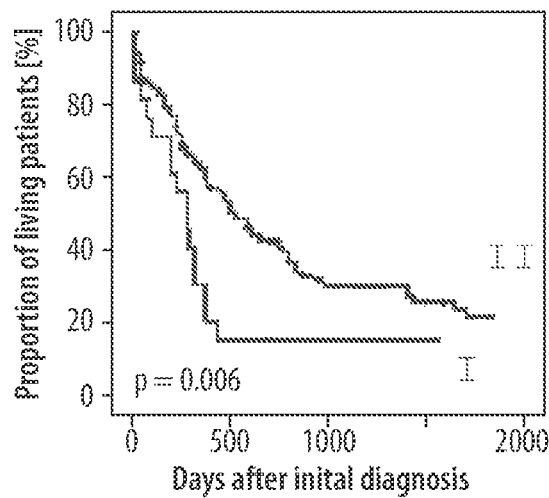
Figure 12E:
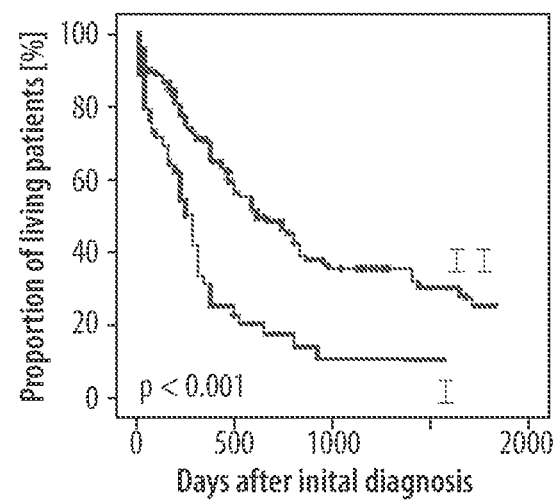
Figure 12F:
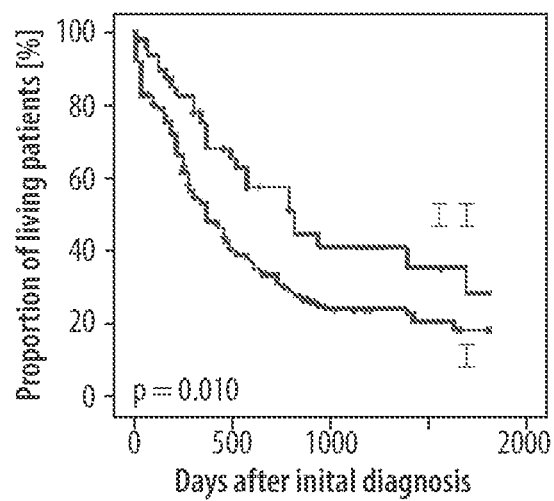
Figure 12G:
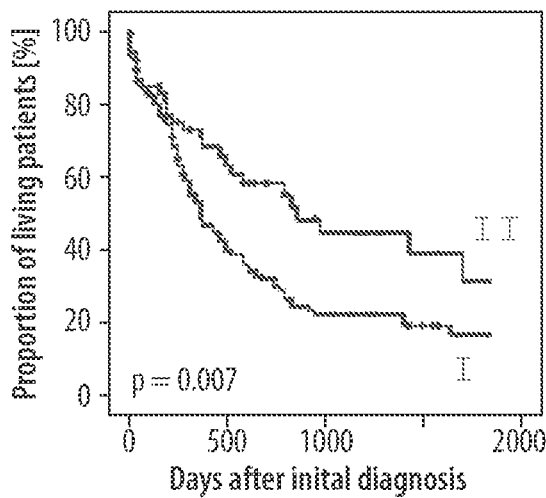
Figure 12H:
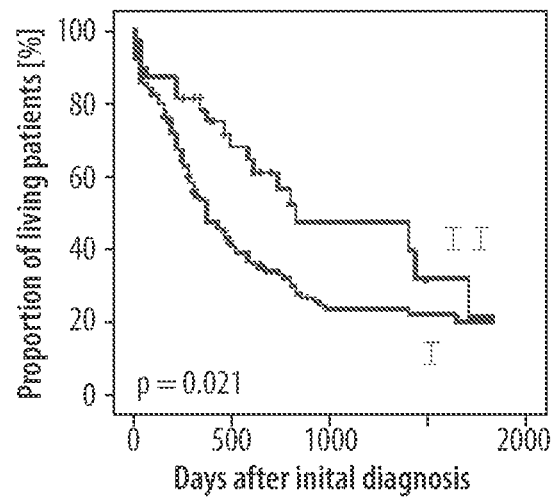
Figure 12I:
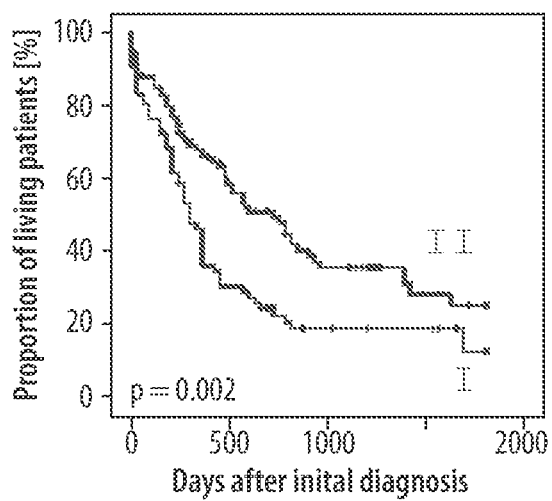
Figure 12J:
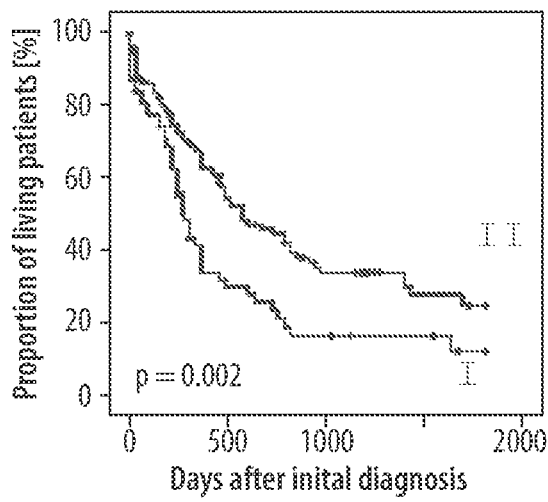
Figure 12K:
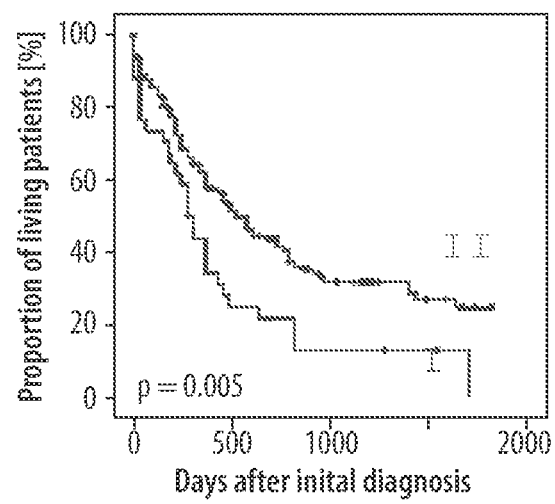
Figure 12L:
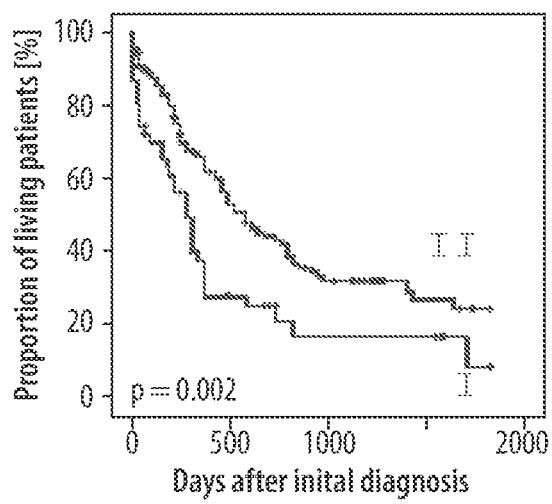

Surprisingly, patients with methylation of the genes CD274, PDCD1 and PDCD1LG2 below the threshold (Group I, FIG. 11A, 11D, 11G) showed an unfavorable prognosis whereas in the previous examples patients with increased methylation of these immunoregulatory genes showed an unfavorable prognosis. It is therefore a surprising finding that the method of the present invention also allows assessing the prognosis of patients with malignant haematological diseases. The analysis of the mRNA expression of the genes CD274, PDCD1 and PDCD1LG2 (FIG. 11B, 11E, 11H) also allowed to determine the prognosis of the patients. Here, too, it is surprising that in the analysis of mRNA expression, those patients with reduced expression (group IV) had a more favorable prognosis, unlike the results described so far in Examples 7 and 8. FIGS. 11C, 11F and 11I illustrate that the combined analysis of DNA methylation and mRNA expression leads to a more differentiated risk assessment compared to the respective individual analysis of mRNA expression and DNA methylation, respectively.

Example 11: Determination of Prognosis of Patients with Acute Myeloid Leukemia Using DNA Methylation Analysis of TNFRSF9, TIGIT, BTLA, HAVCR2, CD80, CTLA4, ICOS, C10orf54, HHLA2, CD160, KIR2DL4 and KIR3DL1

The method of the present invention also enables determining the prognosis of patients with malignant haematological diseases using further immunoregulatory genes. For the DNA methylation analysis, the data collected in Example 10 were used. The determination of the relative methylation of TNFRSF9, TIGIT, BTLA and CTLA4 using the data from the bead pairs was accomplished as described in Example 4. For the determination of the relative methylation level of the genes HAVCR2, CD80, ICOS, C10orf54, HHLA2, CD160, KIR2DL4 and KIR3DL1, the bead pairs mentioned below were used and the relative methylation level was calculated as described in Example 1. For HAVCR2, the bead pair cg09574807 (SEQ ID NO:46) was used, which allowed for the determination of methylation of the gene region SEQ ID NO:286. The methylation of CD80 was determined using bead pairs cg12978275 (SEQ ID NO:126) and cg13458803 (SEQ ID NO:127), which allowed for methylation analysis of the sequence region SEQ ID NO:163. The DNA methylation analysis of the gene ICOS was based on the bead pairs cg18561976 (SEQ ID NO:112) and cg15344028 (SEQ ID NO:113)

which allow for the methylation analysis of the sequence regions SEQ ID NO:92, SEQ ID NO:93 and SEQ ID NO:95. The DNA methylation analysis of HHLA2 was performed using the four bead pairs cg00915092 (SEQ ID NO:122), cg14703454 (SEQ ID NO:123), cg11326415 (SEQ ID NO:124) and cg22926869 (SEQ ID NO:125) which allow for the analysis of the sequence regions SEQ ID NO:36, SEQ ID NO:195 and SEQ ID NO:196. The bead pair ch.10.1529706R (SEQ ID NO:35) was used for DNA methylation analysis of the sequence regions SEQ ID NO:190 and SEQ ID NO:191 of the gene C10orf54. DNA methylation analysis of the sequence regions SEQ ID NO:361, SEQ ID NO:362 and SEQ ID NO:366 within the CD160 gene was performed using the bead pairs cg12832565 (SEQ ID NO:150), cg10798745 (SEQ ID NO:151) and cg15892497 (SEQ ID NO:152). For the DNA methylation analysis of the sequence regions SEQ ID NO:217 and SEQ ID NO:218 of the gene KIR2DL4 the bead pair cg08326410 (SEQ ID NO:143) was used. The DNA methylation analysis of KIR3DL1 was performed using the bead pairs cg15588997 (SEQ ID NO:137), cg08129658 (SEQ ID NO:138), cg02469067 (SEQ ID NO:139), cg19689800 (SEQ ID NO:140), cg06494497 (SEQ ID NO:141) and cg05720980 (SEQ ID NO:142) which allow for methylation analysis of the sequence regions SEQ ID NO:230, SEQ ID NO:231 and SEQ ID NO:232.

FIG. 12 shows the Kaplan-Meier analyses of overall survival of 182 patients with acute myeloid leukemia. Patients were stratified by DNA methylation analysis of the immunoregulatory genes TNFRSF9 (FIG. 12A), TIGIT (FIG. 12B), BTLA (FIG. 12C), HAVCR2 (FIG. 12D), CD80 (FIG. 12E), CTLA4 (FIG. 12F), ICOS (FIG. 12G), C10orf54 (FIG. 12H), HHLA2 (FIG. 12I), CD160 (FIG. 12J), KIR2DL4 (FIG. 12K) and KIR3DL1 (FIG. 12L). Dichotomization was done on the basis of optimized threshold values. The optimization of the threshold value was performed in such a way that an optimal separation, i.e. the lowest possible p-value of the log-rank test, of patients with favorable and poor prognosis was possible. For all analyzed genes it could be shown that patients with malignant disease exhibiting a methylation below the threshold (group I) were associated with an unfavorable course of disease compared to patients with methylation above the threshold.

Example 12: Determination of Prognosis of Patients with Low-Grade Gliomas Using DNA Methylation Analysis and mRNA Expression Analysis of CD274, PDCD1 and PDCD1LG2

The method of the present invention also allows for assessment of the prognosis of patients with gliomas. For example, DNA methylation analysis and mRNA expression analysis of the immunoregulatory genes CD274, PDCD1 and PDCD1LG2 were carried out among 510 patients with low-grade gliomas. DNA and RNA preparation, mRNA expression analysis, DNA methylation analysis and evaluation were performed as described in Examples 1 and 6. The calculation of the relative methylation of the genes CD274, PDCD1 and PDCD1LG2 using the data generated by the Illumina Human Methylation450 BeadChip was performed as described in Example 3.

Figure 13A:
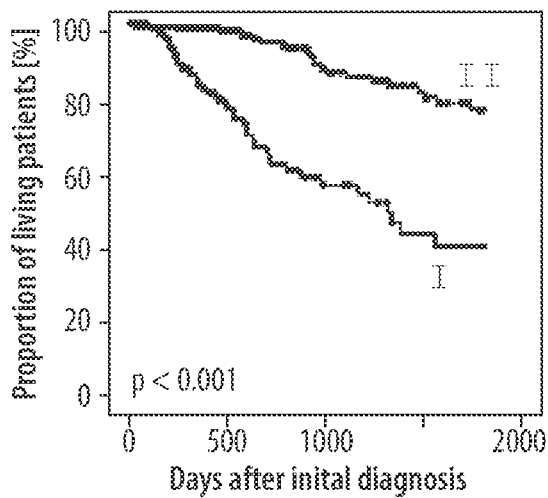
Figure 13B:
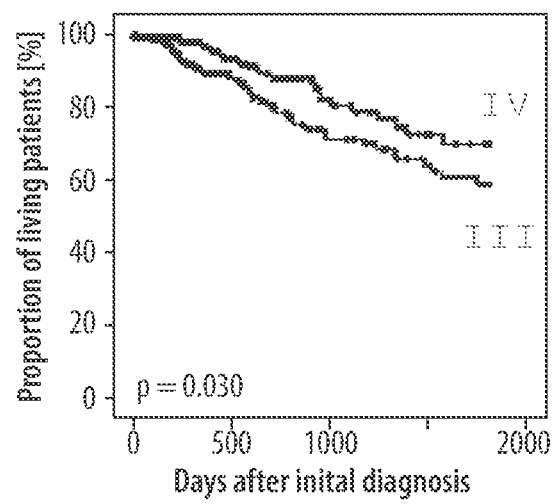
Figure 13C:
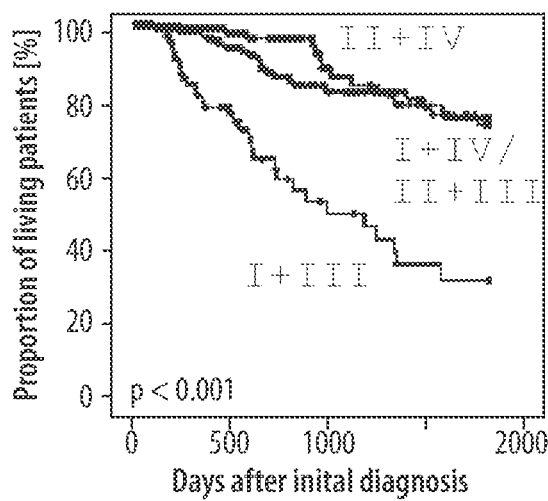
Figure 13D:
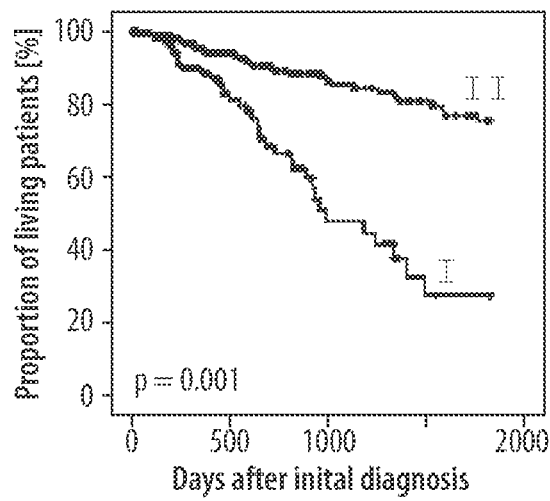
Figure 13E:
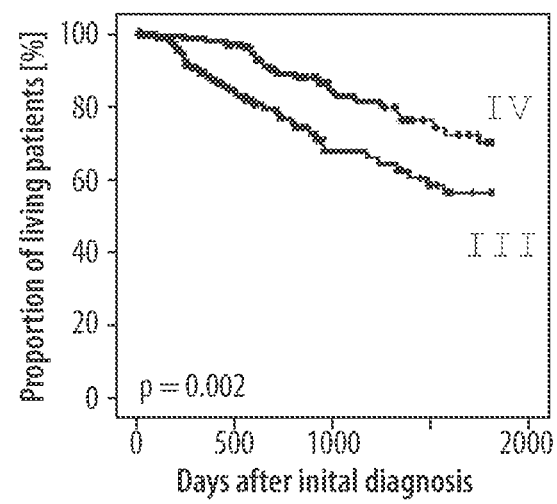
Figure 13F:
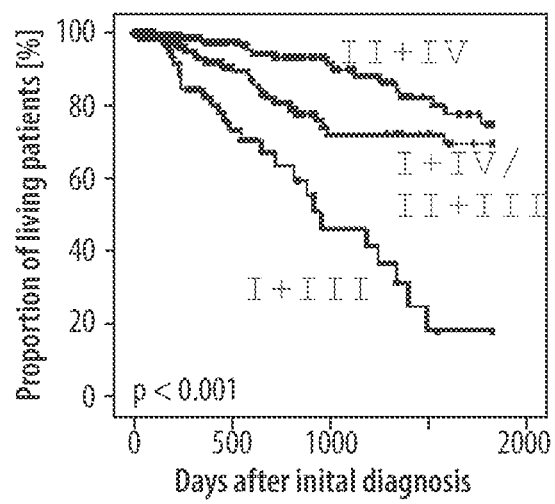
Figure 13G:
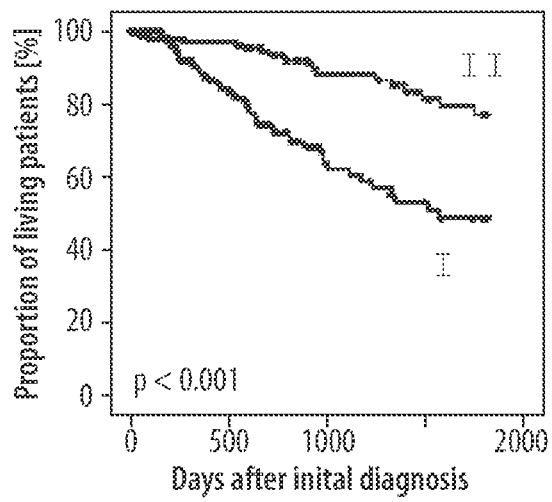
Figure 13H:
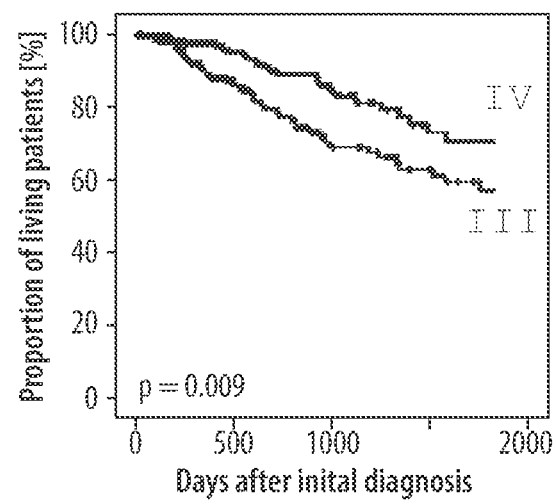
Figure 13I:
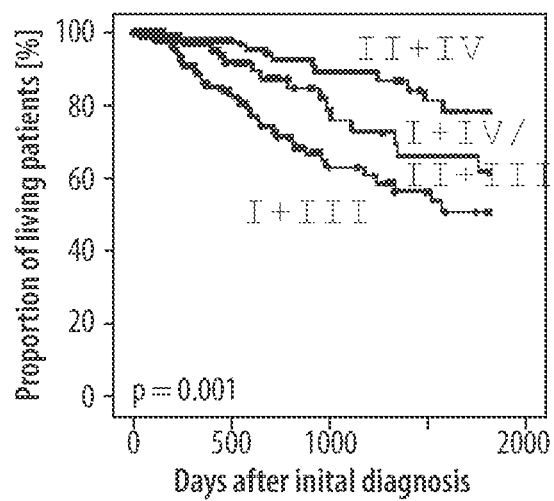
Figure 14A:
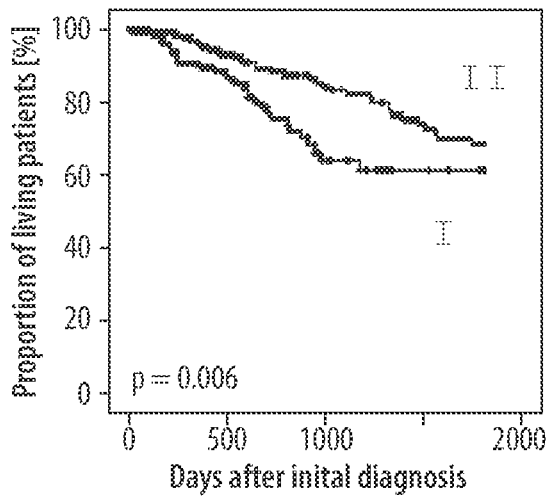
Figure 14B:
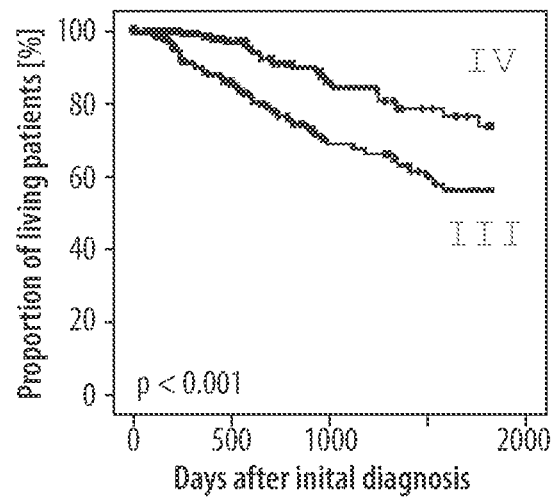
Figure 14C:
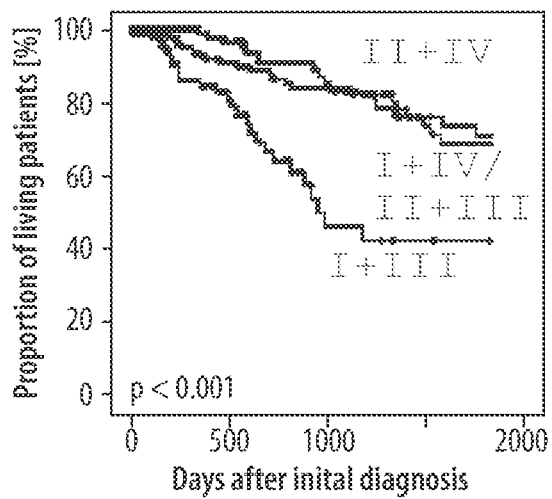
Figure 14D:
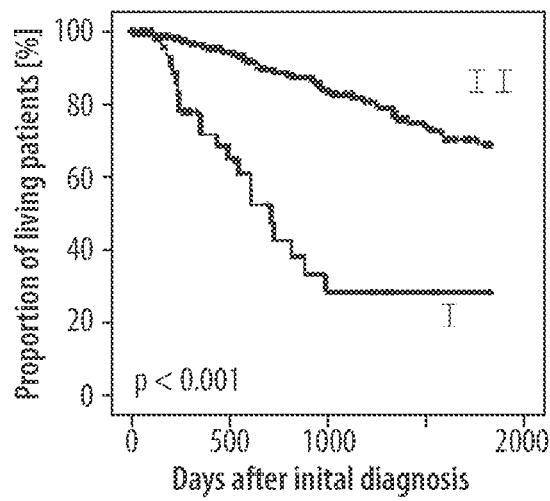
Figure 14E:
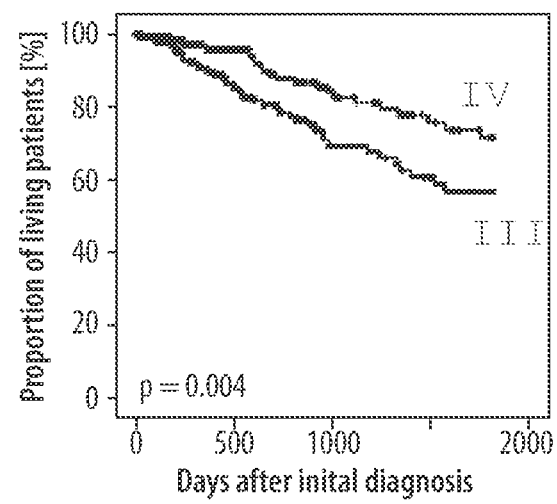
Figure 14F:
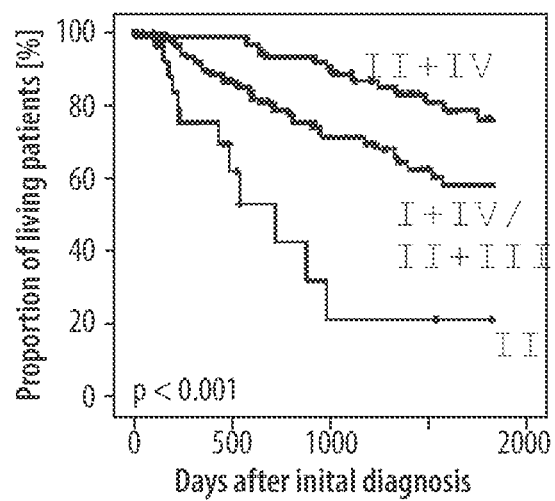
Figure 14G:
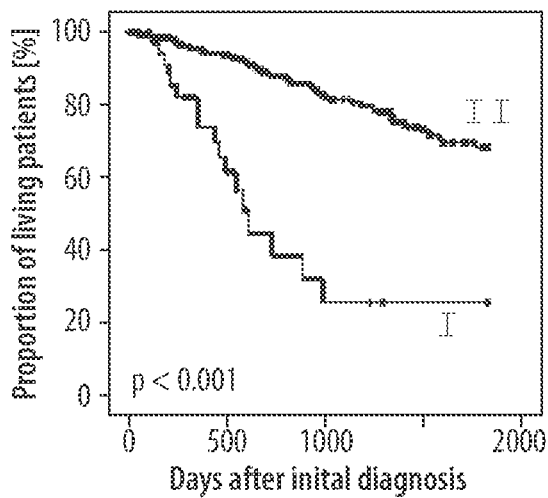
Figure 14H:
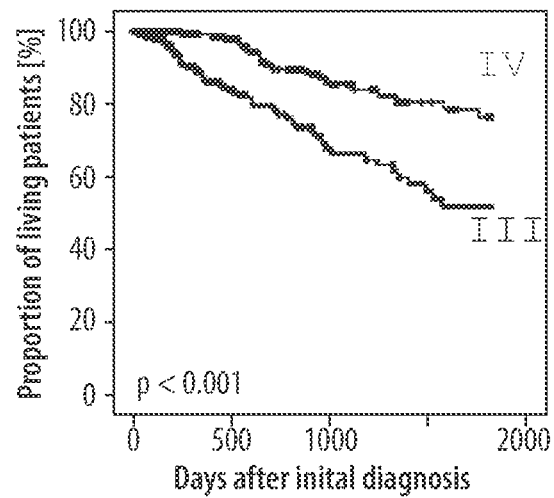
Figure 14I:
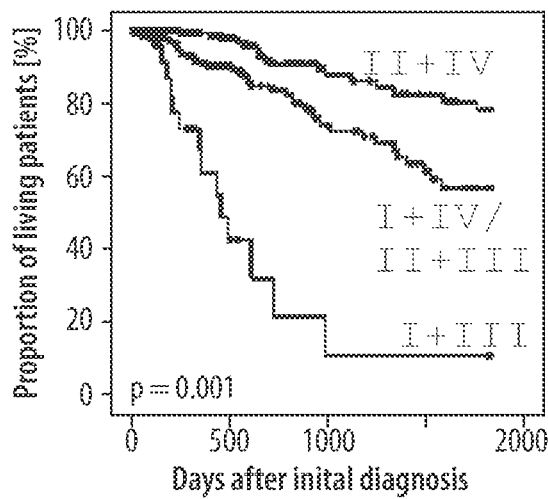
Figure 14J:
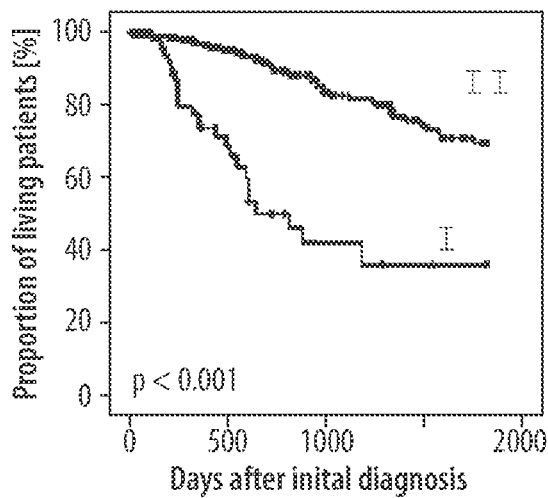
Figure 14K:
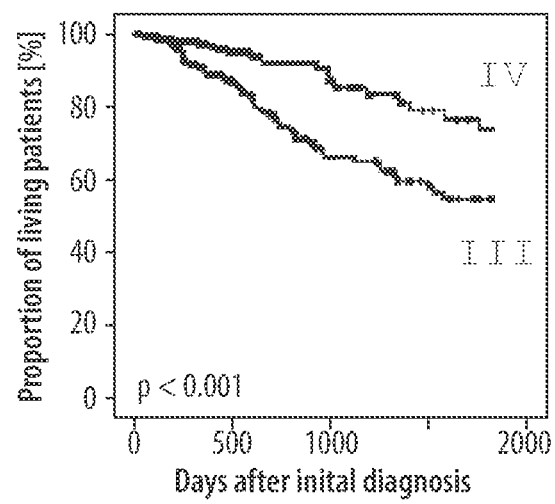
Figure 14L:
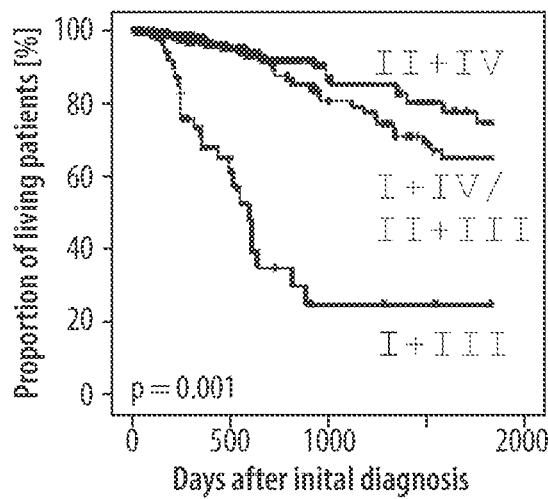
Figure 15A:
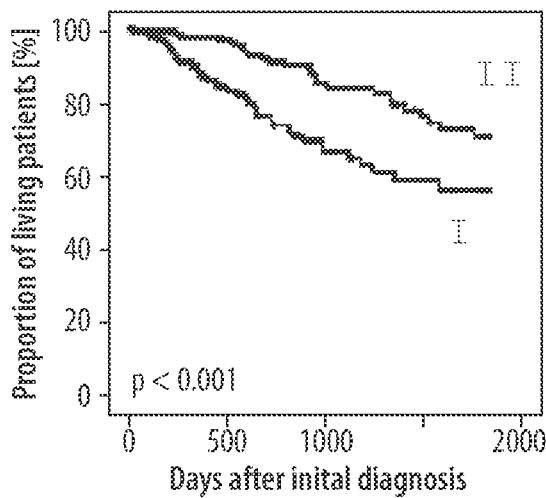
Figure 15B:
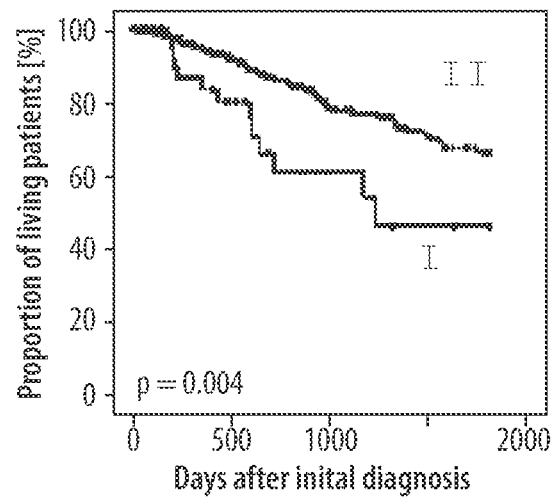
Figure 15C:
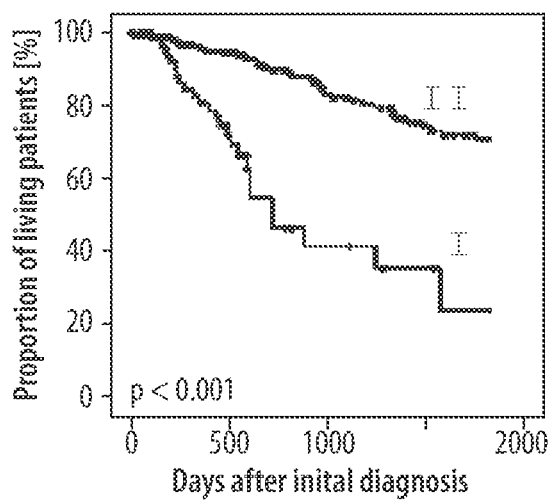
Figure 15D:
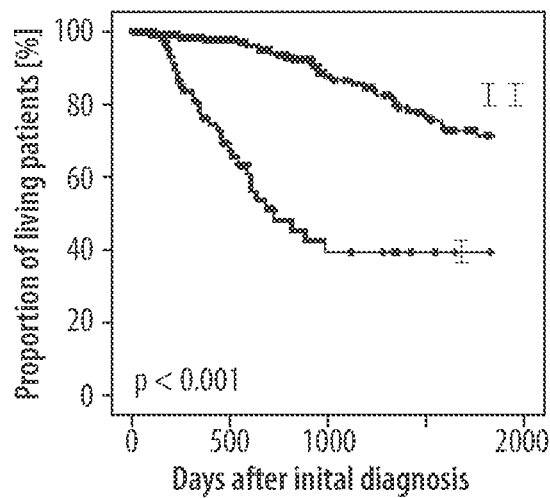
Figure 15E:
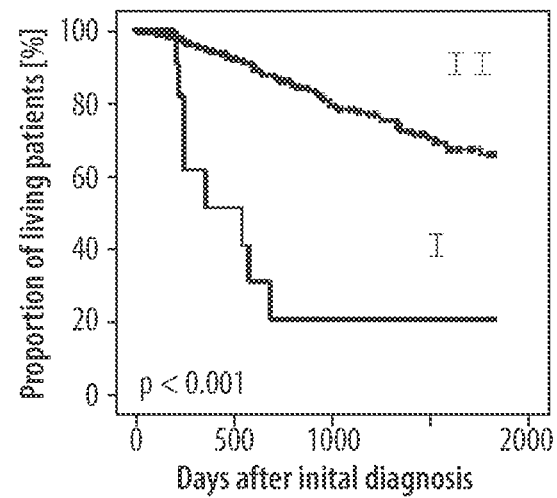
Figure 15F:
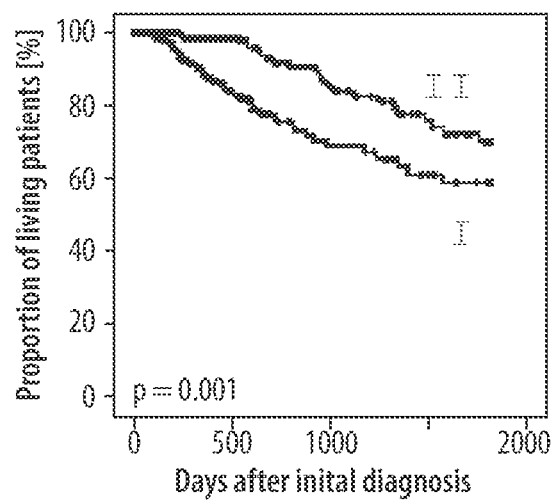
Figure 15G:
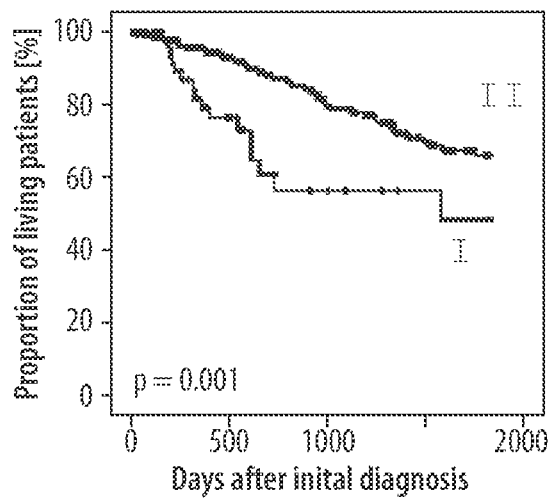
Figure 15H:
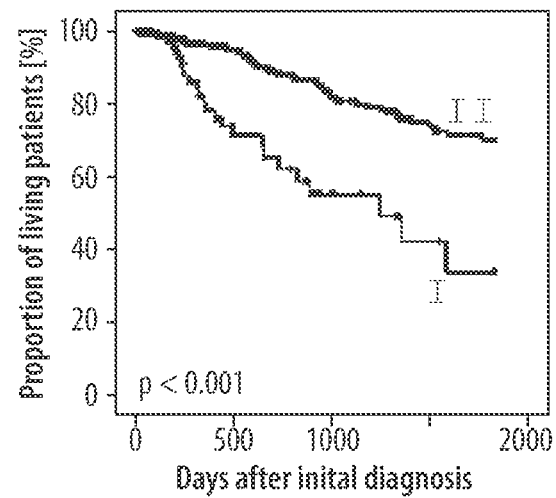
Figure 15I:
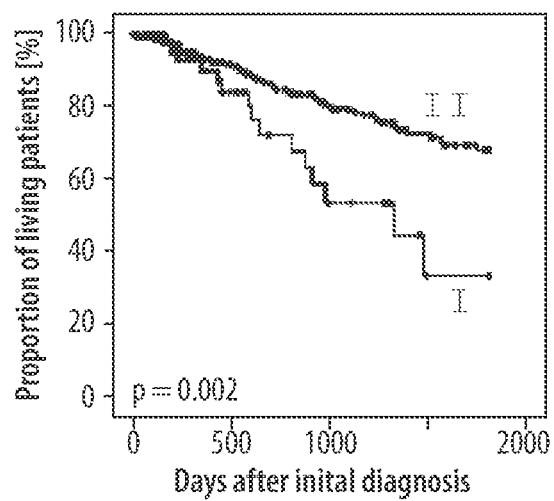
Figure 15J:
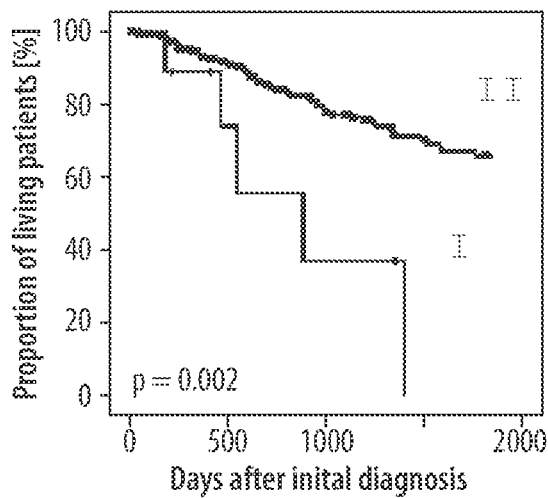
Figure 15K:
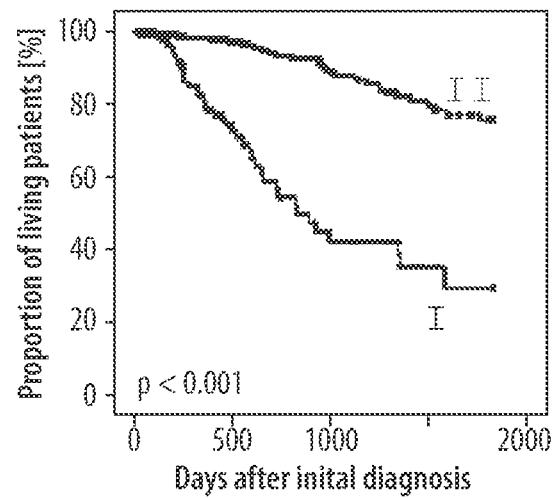
Figure 15L:
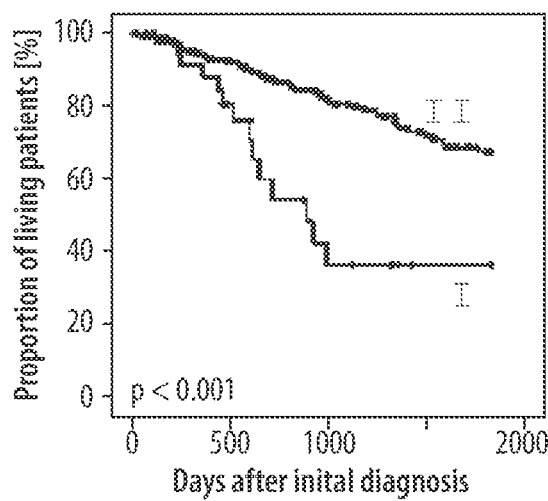
Figure 16A:
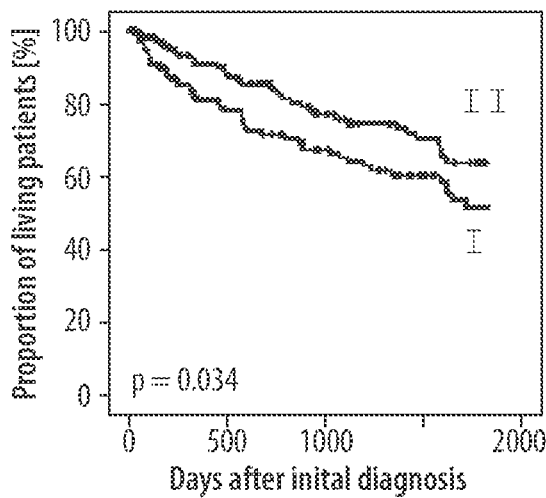
Figure 16B:
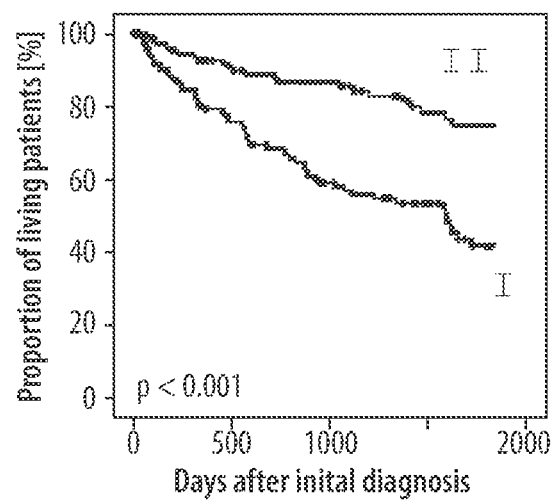
Figure 16C:
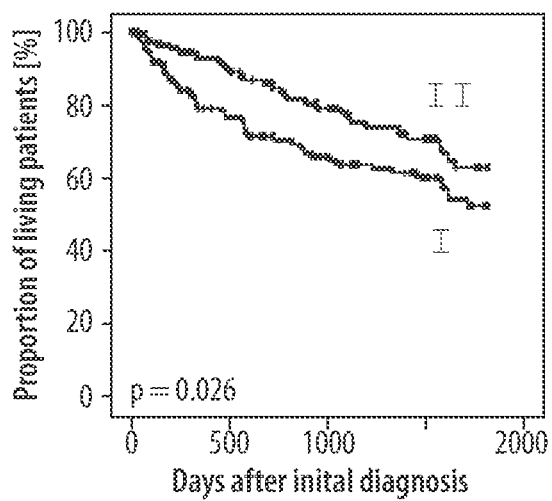
Figure 16D:
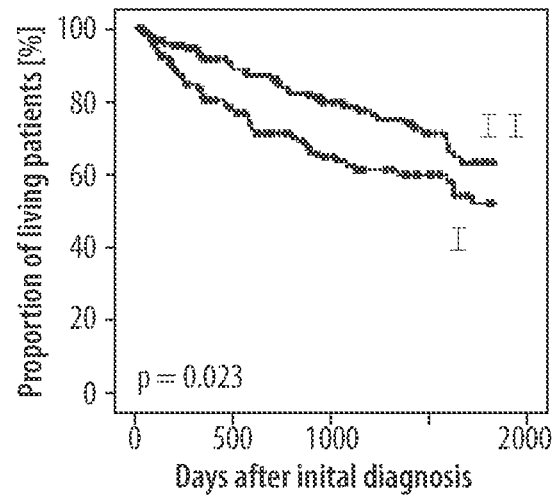
Figure 16E:
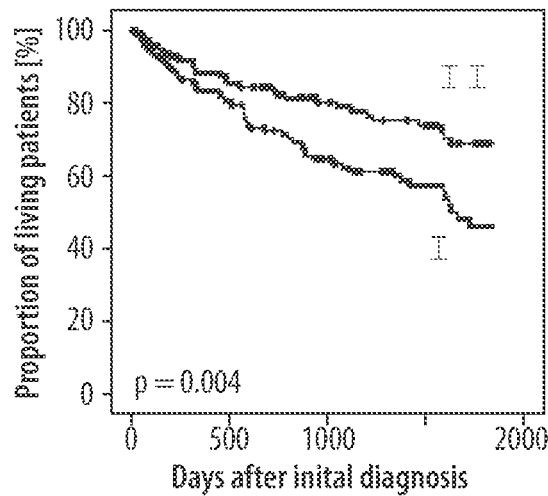
Figure 16F:
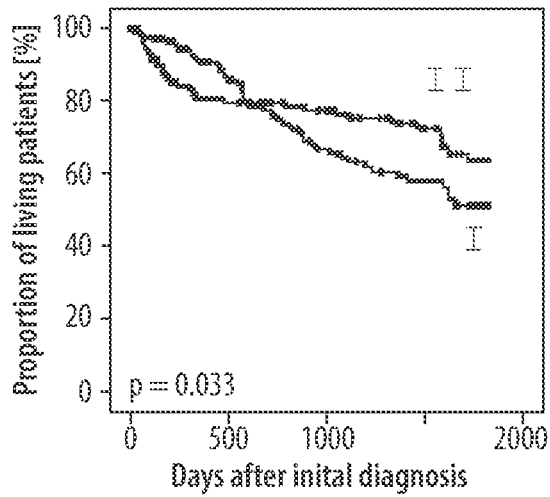
Figure 16G:
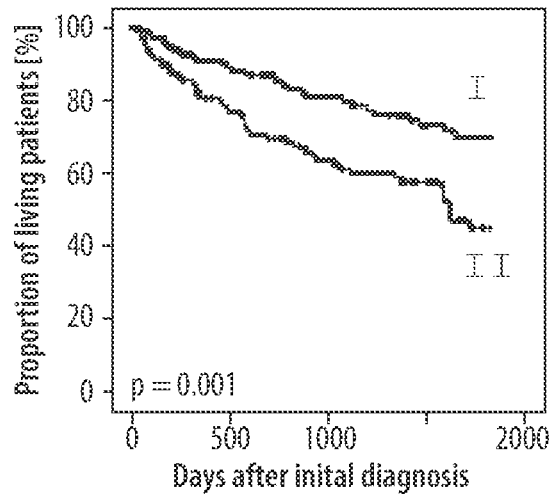
Figure 17A:
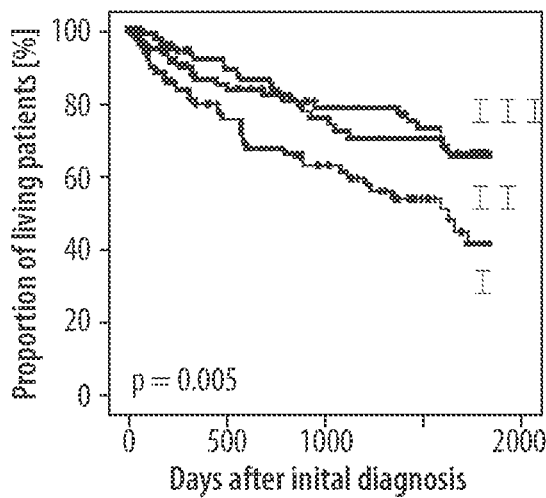
Figure 17B:
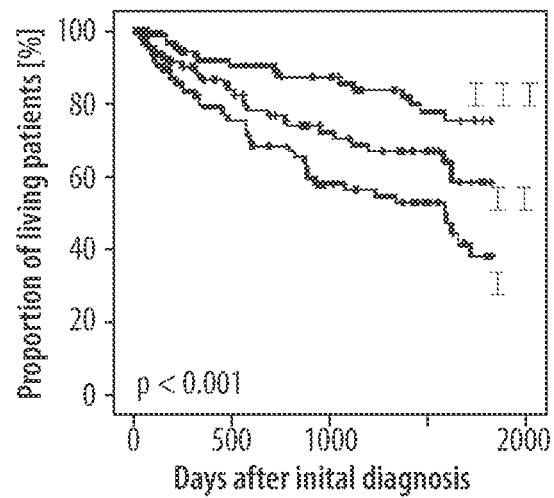
Figure 17C:
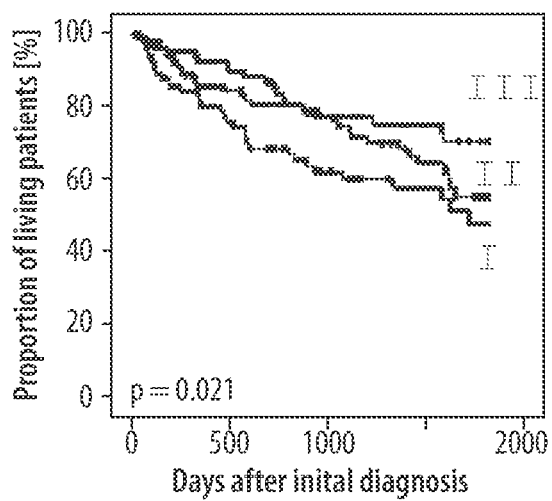
Figure 17D:
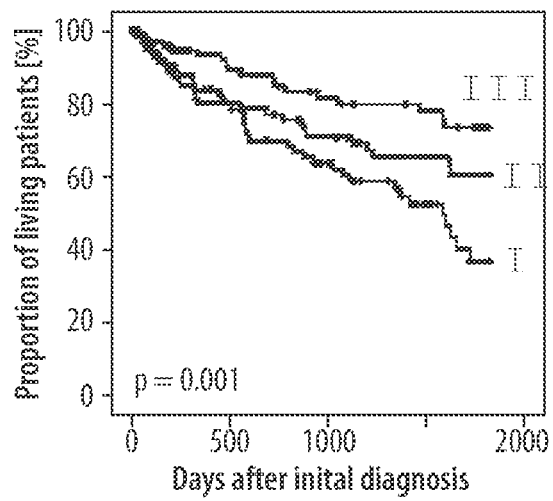
Figure 17E:
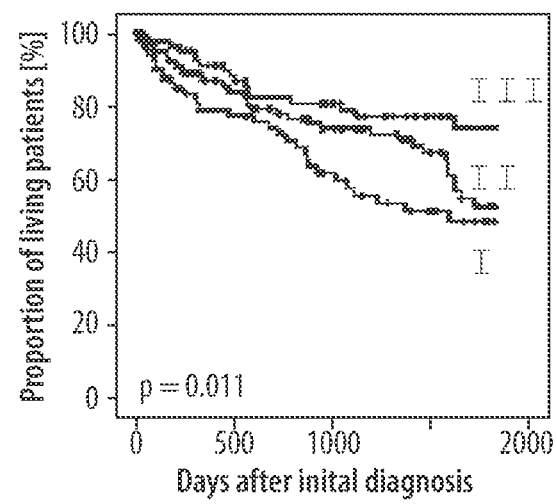
Figure 17F:
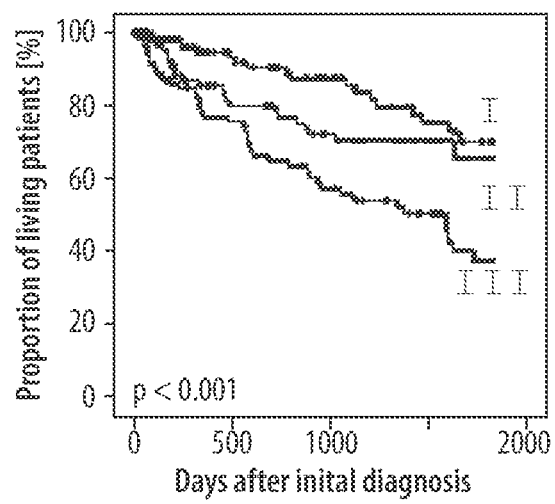

As already demonstrated in Example 11 for malignant haematological diseases, the DNA methylation analysis, mRNA expression analysis and the combination of both analyses also allows determining the prognosis of patients with gliomas. FIG. 13 shows that patients with methylation of the immunoregulatory genes in cells of the glioma below the threshold (group I) had a significantly poorer prognosis than patients whose tumors exhibited methylation above the threshold (group II). This was equally demonstrated for the three genes CD274 (FIG. 13A), PDCD1 (FIG. 13D) and PDCD1LG2 (FIG. 13G). In the analysis of the corresponding mRNA expression of the immunoregulatory genes, the patients with a poor prognosis could also be identified by an increased expression of the genes (group III). Again, the combination of mRNA expression analysis and DNA methylation analysis in accordance with the present invention proved to be particularly advantageous, resulting in the formation of three prognosis groups, which had a high risk (group I+III), a medium risk (group I+IV/II+III) and a low risk (group II+IV) of death. As already shown for malignant haematological diseases in Examples 10 and 11, it is also a surprising finding for gliomas that, in contrast to the previous analyses of malignant diseases, reduced mRNA expression and increased DNA methylation were associated with a favourable prognosis. This highlights the capacity of the present invention with regard to the determination of the prognosis of patients with various malignant diseases.

Example 13: Determination of Prognosis of Patients with Low-Grade Gliomas Using DNA Methylation Analysis and mRNA Expression Analysis of CD80, CTLA4, ICOS and CD276

The determination of the prognosis of patients with gliomas in accordance with the present invention is also possible on the basis of DNA methylation analysis and mRNA expression analysis of the immunoregulatory genes CD80, CTLA4, ICOS and CD276. The present analysis is based on the methylation and expression data collected as described in Example 12. The determination of the relative DNA methylation of the genes CD80, CTLA4 and ICOS was performed as described in Examples 11 and 4. To determine the relative DNA methylation of the CD276 gene, the bead pairs cg24688248 (SEQ ID NO:119), cg14910296 (SEQ ID NO:120) and cg12524179 (SEQ ID NO:121) were used and mathematically evaluated as described in Example 1. These bead pairs allow for determination of DNA methylation in the sequence regions SEQ ID NO:181, SEQ ID NO:182 and SEQ ID NO:183.

FIG. 14 shows the Kaplan-Meier analysis of overall survival of the 510 patients with low-grade gliomas who were analyzed. Patients were stratified by DNA methylation analysis (FIGS. 14A, 14D, 14G, 14J), mRNA expression analysis (FIGS. 14B, 14E, 14H, 14K) and combined DNA methylation and mRNA expression analysis (FIG. 14C, 14F, 14I, 14L) of the immunoregulatory genes CD80 (FIG. 14A, B, C), CTLA4 (FIG. 14D, E, F), ICOS (FIG. 14G, 14H, 14I) and CD276 (14J, 14K, 14L). For the dichotomization based on DNA methylation, the following thresholds were defined: 90.76% (CD80), 86.43% (CTLA4), 84.75% (ICOS) and 30.08% (CD276). For the dichotomization of mRNA expression, the median was used as the threshold. Group I comprises patients with methylation below the threshold, group II is formed by patients with methylation above the threshold. Group III comprises patients whose tumors exhibited mRNA expression above the median, whereas patients from group IV showed mRNA expression in the tumor below the median. As already shown in Example 12 and FIG. 13 for CD274, PDCD1 and PDCD1LG2, it was also possible to determine the prognosis of the patients on the basis of DNA methylation and mRNA expression of the genes CD80, CTLA4, ICOS and CD276 as well as the combination of both analyses. In this case again, it was a surprising finding that high DNA methylation and low mRNA expression of the immunoregulatory genes of the present invention were associated with a more favorable course of the disease.

Example 14: Determination of Prognosis of Patients with Low-Grade Gliomas Using DNA Methylation Analysis of TNFRSF25, TNFRSF9, CD40, TIGIT, BTLA, HAVCR2, C10orf54, HHLA2, LAG3, CD160, KIR2DL4 and KIR3DL1

It is also possible to assess the prognosis of patients with low-grade gliomas by DNA methylation analysis of other immunoregulatory genes. The results presented in FIG. 15 are based on an analysis of DNA methylation data that were generated as described in Example 12. The bead pairs used to determine the relative DNA methylation level of the genes TNFRSF9, CD40, TIGIT, BTLA, HAVCR2, C10orf54, HHLA2, LAG3, CD160, KIR2DL4 and KIR3DL1 and the calculation of the DNA methylation are described in examples 1, 4 and 11. For the determination of the DNA methylation of the gene TNFRSF25, the bead pairs cg27224823 (SEQ ID NO:153), cg13331246 (SEQ ID NO:154), cg23588699 (SEQ ID NO:155) and cg10982045 (SEQ ID NO:156) can be used, for example, which allow for DNA methylation analysis of the sequence regions SEQ ID NO:317, SEQ ID NO:318 and SEQ ID NO:319. The bead pairs cg00087884 (SEQ ID NO:157), cg10059687 (SEQ ID NO:158) and cg11756870 (SEQ ID NO:159) can also be used for DNA methylation analysis of the sequence regions SEQ ID NO:317, SEQ ID NO:320 and SEQ ID NO:321.

FIG. 15 shows the Kaplan-Meier analysis of overall survival of 510 patients with low-grade gliomas who were stratified retrospectively using DNA methylation analysis of the genes TNFRSF25 (A), TNFRSF9 (B), CD40 (C), TIGIT (D), BTLA (E), HAVCR2 (F), C10orf54 (G), HHLA2 (H), LAG3 (I), CD160 (J), KIR2DL4 (K) and KIR3DL1 (L). The stratification of the patients was based on a dichotomized relative methylation level of the genes using the following thresholds: 61.88° (TNFRSF25), 79.24° (TNFRSF9), 43.24° (CD40), 80.66° (TIGIT), 84.64% (BTLA), 2.495% (HAVCR2), 66.52% (C10orf54), 77.14% (HHLA2), 74.34% (LAG3), 92.89% (CD160), 90.85% (KIR2DL4) and 52.28% (KIR3DL1). Group I comprises patients with DNA methylation below the threshold; Group II represents those patients whose tumor exhibited DNA methylation above the threshold. For all immunoregulatory genes it could be shown that low DNA methylation is associated with a poor prognosis of the patients.

Example 15: Determination of Prognosis of Patients with Clear Cell Renal Cell Carcinoma Using DNA Methylation Analysis of CD274, TNFRSF9, TIGIT, CD80, CTLA4, CD276 and HHLA2

It has already been demonstrated in the previous examples that the method of the present invention allows to determine the prognosis of patients with various malignant diseases such as adenocarcinomas, squamous cell carcinomas, melanomas, leukaemias and gliomas. In this example, the method of the present invention was applied to patients with clear cell renal cell carcinoma. The DNA methylation data were generated as described in Example 1. The calculation of relative DNA methylation using the data from the bead pairs for the genes CD274, TNFRSF9, TIGIT, CD80, CTLA4, CD276 and HHLA2 was done as described in Examples 3, 4, 11 and 13.

FIG. 16 shows the Kaplan-Meier analyses of overall survival of 318 patients with clear cell renal cell carcinoma retrospectively stratified by DNA methylation of the immunoregulatory genes TIGIT (A), TNFRSF9 (B), CD274 (C), CD80 (D), CTLA4 (E), CD276 (F) and HHLA2 (G). For each gene, the dichotomization of the relative DNA methylation values was based on the respective median of DNA methylation of all patients. Group I includes patients whose tumors had DNA methylation below the median, whereas group II includes patients whose tumors had DNA methylation above the median. FIG. 16 shows that in six of the seven genes analyzed, increased DNA methylation (Group I) correlated significantly with a less favorable prognosis. For the gene HHLA2 it was surprisingly shown that the prognosis of patients with clear cell renal cell carcinoma is unfavorable if the immunoregulatory gene showed methylation below the threshold (FIG. 16G). The results demonstrate that the method of the present invention is applicable for further carcinomas in addition to the adenocarcinomas and squamous cell carcinomas presented in the previous examples.

Example 16: Determination of Prognosis of Patients with Clear Cell Renal Cell Carcinoma Using DNA Methylation Analysis in Combination with mRNA Expression Analysis of TNFRSF9, TIGIT, CD80, CTLA4, CD276 and HHLA2

The universal applicability of the method of the present invention in various malignant diseases was further verified by a combined analysis of mRNA expression and DNA methylation for the genes TNFRSF9, TIGIT, CD80, CTLA4, CD276 and HHLA2 in 318 patients with clear cell renal cell carcinoma. DNA methylation analysis and mRNA expression analysis were carried out and evaluated as described in Examples 1 and 6. The calculation of the relative methylation levels of the genes from the bead pairs used is described in Examples 4, 11 and 13.

FIG. 17 shows the Kaplan-Meier analysis of the overall survival of the 318 patients with clear cell renal cell carcinoma stratified by the combined analysis of DNA methylation and mRNA expression of the genes TIGIT (A), TNFRSF9 (B), CD80 (C), CTLA4 (D), CD276 (E) and HHLA2 (F). The dichotomization was based on the median of methylation or mRNA expression, respectively, of all patients. Group I: methylation below and mRNA above the median; Group III: methylation above and mRNA below the median; Group II: methylation above and mRNA above the median or methylation below and mRNA below the median. For the six genes analyzed in this example, it was demonstrated that it was possible to divide the patients into three groups, either with a high, medium or low risk of death. While for the genes TIGIT (A), TNFRSF9 (B), CD80 (C), CTLA4 (D) and CD276 (E) a high DNA methylation and lower mRNA expression (group I) were associated with a particularly poor prognosis, the gene HHLA2 (F) showed an exactly reversed correlation, which also confirmed the surprising result already described in Example 15 for the DNA methylation analysis of this gene alone.

As already shown in Examples 13, 12, 10, 8 and 7, the combined analysis of DNA methylation and mRNA expression of immunoregulatory genes of the present invention provides a particularly advantageous embodiment of the method by enabling a more differentiated prognosis in comparison to the individual analyses.

Example 17: Determination of Response of Patients with Malignant Melanoma to Immunotherapy by DNA Methylation Analysis of PDCD1 and CD274

The application of DNA methylation analysis of an immunoregulatory gene to predict the response to immunotherapy according to the present invention was tested on a cohort of 23 patients with malignant melanoma. Patients received immunotherapy with pembrolizumab. This compound is a monoclonal antibody directed against the PDCD1 receptor encoded by the immunoregulatory gene PDCD1. By interacting with the PDCD1 receptor, the antibody prevents the binding of the corresponding ligands encoded by CD274 and PDCD1LG2 and thus alters the immunoregulatory effect of both PDCD1 and CD274 and/or PDCD1LG2. Of the 23 patients, 11 showed disease progression (patients 13 to 23), 11 patients (patients 2 to 12) had stable disease or showed tumor mass reduction. In one patient (patient 1), the tumor decreased to such an extent that it was no longer detectable.

For the DNA methylation analysis of the immunoregulatory genes PDCD1 and CD274 DNA was obtained from cells of cutaneous metastases, lymph node metastases and distant metastases from tumor patients. The metastases were removed surgically prior to immunotherapy. Bisulfite converted DNA was prepared as described in Example 2. The DNA methylation analysis of the immunoregulatory genes was performed by quantitative real-time PCR as described in Examples 2 and 5 for CD274 and PDCD1, respectively.

FIG. 18 shows the patient-dependent DNA methylation of the immunoregulatory gene CD274, which encodes the ligand CD274 that binds to the receptor PDCD1 encoded by the immunoregulatory gene PDCD1. Patients 13 to 23 who showed no response to pembrolizumab therapy exhibited an average DNA methylation of 18.5% in the tumor, whereas the group of patients who responded partially or completely (patients 1 to 12) showed an average DNA methylation of only 6.2% in the tumor.

Using the DNA methylation analysis of the CD274 gene and the pharmaceutical compound pembrolizumab as examples, the results show that the response to immunotherapy can be predicted by the method according to the present invention. In particular, the results show that it is possible to select patients on the basis of DNA methylation, for example in such a way that only those patients receive a therapy with pembrolizumab who have a low DNA methylation of the CD274 gene, for instance below 10%, because the probability of responding to the therapy is lower in patients with high DNA methylation in the present example. Of the patients 1 to 12 with partial or complete response, ten (83%) showed DNA methylation of CD274 below 10% and could thus be accurately identified in this example as patients with a likely response to therapy. A total of eight patients showed CD274 methylation of over 10%. Six of these eight patients (75%) were correctly predicted not to respond to the immunotherapy.

This example shows that the determination of the DNA methylation of an immunoregulatory gene according to the invention is generally suitable for predicting the response to immunotherapy. Accordingly, this is also possible if the immunoregulatory gene encodes a ligand as the immune checkpoint and a pharmaceutical compound is used which is designed to alter the immunoregulatory effect of the ligand by inhibiting the corresponding receptor of the ligand. The results further demonstrated that the DNA methylation analysis of an immunoregulatory gene is also suitable for predicting the response to a pharmaceutical compound that interacts antagonistically with an immune checkpoint encoded by another immunoregulatory gene.

FIG. 19 shows the corresponding determination of DNA methylation of the immunoregulatory gene PDCD1 in accordance with the invention. In the group of patients 1 to 12 who showed a response, an average of 59% methylation of the PDCD1 gene was found in the tumor samples. This methylation was significantly higher with a p-value of 0.008 in a t-test than the methylation in the tumors of the patients who showed progression of the disease and who had a mean methylation of 22%. The level of DNA methylation of the PDCD1 gene therefore also correlates with the response to immunotherapy and allows for the DNA methylation of PDCD1 to be used to identify those patients who are likely to respond to therapy before starting the therapy. For example, the tumors of nine of the twelve (75%) responding patients (patients 1 to 12) exhibited a DNA methylation of the PDCD1 gene of over 25% and could thus be correctly identified as responding patients. The patient with a complete tumor decline due to immunotherapy (patient 1) showed the highest methylation of all investigated samples (98%) and could therefore most reliably be identified. In contrast, nine of the eleven (82%) patients (patients 13-23) who did not respond to therapy exhibited PDCD1 methylation below 25% and were correctly identified as patients who do not respond to the selected immunotherapy with pembrolizumab. In the future, using the method according to the present invention such patients could for instance be exempted from immunotherapy with pembrolizumab and its side effects. At the same time, valuable time could be gained by applying a different therapy that is more likely to have an effect to these patients earlier. For example, an individualized selection of the alternative therapy could have been made by using the method of the invention for determining the DNA methylation of further immunoregulatory genes encoding immune checkpoints in order to predict the response to a therapy with pharmaceutical compounds that are able to alter the immunoregulatory effect of these further immune checkpoints.

FIG. 19 also shows by way of example that consideration of the quantity of methylation of an immunoregulatory gene can be used to predict the response to therapy. This allows to predict a patient's response to therapy even without applying a threshold value. In the present example, patient 1, in which the tumor was completely remitted, shows a higher methylation of the PDCD1 gene than patients 2 to 12, who responded only partially to the therapy.

It is also possible to combine the DNA methylation analysis from different immunoregulatory genes according to the invention to predict the response to immunotherapy even more precisely. FIGS. 18 and 19 illustrate that patient 1, who showed a complete remission, had both low CD274 DNA methylation (3.6%) and high PDCD1 methylation (98%) in the tumor. CD274 encodes the ligand that binds to the PDCD1 encoded receptor. Pembrolizumab is a compound that alters the immunoregulatory effect of the two immune checkpoints encoded by these genes by interrupting or inhibiting this ligand-receptor binding. This finding shows that the analysis of several immune checkpoints in accordance with the present invention, in particular those involved in the same ligand-receptor binding, can further improve the prediction of the response to immunotherapy. This can also be observed in the present example from the fact that of the 12 patients (patients 1 to 12) who responded at least partially to the therapy, all (100%) were characterized either by CD274 methylation below 10% or by PDCD1 methylation above 25%. Thus, the response to immunotherapy could be correctly predicted for these patients. Of the 11 patients with no therapy response (patients 13-23), 5 (45%) showed CD274 methylation above 10% and PDCD1 methylation below 25% (patients 14 to 16, 19 and 21). For these patients, the combined DNA methylation analysis of PDCD1 and CD274 was particularly reliable in predicting the absence of therapy response.

Example 18: Determination of Prognosis of Patients with Squamous Cell Carcinoma of the Head and Neck Using DNA Methylation Analysis and mRNA Expression Analysis of Various Immunoregulatory Genes DNA methylation analysis was performed as described in Example 1. The bead pairs of the Infinium Human Methylation450 BeadChip (Illumina, Inc., San Diego, Calif., USA) listed in Table 1 were used to calculate the relative methylation of the individual immunoregulatory genes described in Table 1. The target sequence of these bead pairs in the genome is also indicated in Table 1 by a corresponding SEQ ID NO. For each bead pair, a relative methylation was calculated for each patient by correlating the beads specific to the unmethylated and methylated state of a pair as described in Example 1. As in Example 5, the overall survival of 528 patients with squamous cell carcinoma of the head and neck area was investigated.

The determination of mRNA expression was performed as described in Example 6. The mRNAs listed in Table 2 were investigated.

The results summarized in Table 1 show that the determination of DNA methylation of the immunoregulatory genes according to the invention is significantly associated with the survival of the patients and thus allows for the determination of the prognosis of the patients. Hazard ratio 1 was determined using the Cox Proportional Hazard Model and expresses the extent to which the patient's risk of dying increases with the increase in DNA methylation of the corresponding immunoregulatory gene. Hazard ratios greater than one mean that the patient's risk of dying increases with higher DNA methylation levels. If the hazard ratio is less than one, this risk is reduced.

This example shows, firstly, that the DNA methylation analysis of the immunoregulatory genes listed in Table 1 according to the invention allows for the determination of the prognosis of the patients. Furthermore, this example shows that prognosis can be determined not only by dividing patients into groups with different prognoses based on methylation thresholds, but also by statistical models such as the Cox Proportional Hazards Model, which can be used to determine the extent to which a patient's prognosis changes depending on the respective methylation value.

By way of the gene examples ADORA2A, BTNL2, C10orf54, CD160, CD276, CD48, CD80, CD86, PDCD1, TIGIT and TNFRSF18, Table 1 also shows that different regions within a gene can be suitable for the method of the present invention. This is shown by the fact that for these genes DNA methylation analysis of a large number of regions, which were examined by means of the different bead pairs, in each case allows for a successful determination of the prognosis.

Hazard Ratio 2 in Table 1 describes the extent to which patients with tumors whose methylation value is above a threshold have a higher risk of death compared to patients with values below the threshold. For example, in the case of the immunoregulatory gene CD274 it was surprisingly demonstrated for the two regions with SEQ ID NO:425 and SEQ ID NO:426 that increased methylation is associated with a low risk of death, while in Example 3 it was shown that increased methylation of other regions of the CD274 gene is associated with poorer survival in malignant melanoma. A similar finding was found for CD276. DNA methylation analysis of the regions of CD276 covered by SEQ ID NO:427, SEQ ID NO:428 and SEQ ID NO:429 correlates inversely with survival, i.e. increased methylation of these regions is associated with a lower risk of death. Conversely, methylation of the region with SEQ ID NO:430 is positively correlated with the risk of death. A particular advantage of DNA methylation analysis according to the present invention is that by selecting one or more regions in the gene for investigation, an even more differentiated prognosis can be achieved than is possible, for example, with mRNA expression or protein expression alone.

TABLE 1

Results of overall survival analysis of 528 patients with squamous cell carcinoma of the head and neck area. The relationship between DNA methylation of the listed genes and the survival of the patients was investigated. For the genes listed several times in the table, the methylation analysis according to the present invention was carried out with the specified bead pairs covering different areas of the corresponding gene. These regions are identified by the sequence with the respective SEQ ID NO. Hazard ratio 1 refers to the methylation value without previous dichotomization, hazard ratio 2 describes the relatively higher risk of patients with methylation values above the threshold to die compared to patients with values below the threshold. The p-values 1 and 2 refer to the respective hazard ratios 1 and 2.

| Gene | SEQ ID NO | Bead-Pair | p-value 1 | Hazard Ratio 1 | Threshold value | p-value 2 | Hazard Ratio 2 |
| --- | --- | --- | --- | --- | --- | --- | --- |
| ADORA2A | SEQ ID NO: 395 | cg04250930 | <0.001 | 6.57 | 64.12 | <0.001 | 1.99 |
| ADORA2A | SEQ ID NO: 396 | cg08025954 | <0.001 | 9.54 | 42.9 | <0.001 | 1.87 |
| ADORA2A | SEQ ID NO: 397 | cg23763137 | <0.001 | 11.34 | 40.14 | <0.001 | 1.87 |
| ADORA2A | SEQ ID NO: 398 | cg01373166 | <0.001 | 10.86 | 55.96 | <0.001 | 1.98 |
| ADORA2A | SEQ ID NO: 399 | cg02237342 | <0.001 | 6.41 | 53.38 | <0.001 | 2.14 |
| ADORA2A | SEQ ID NO: 400 | cg20660269 | <0.001 | 7.29 | 55.44 | <0.001 | 2.05 |
| ADORA2A | SEQ ID NO: 401 | cg12793123 | <0.001 | 13.67 | 49.78 | <0.001 | 1.81 |
| ADORA2A | SEQ ID NO: 402 | cg26001125 | 0.001 | 7.89 | 48.88 | <0.001 | 1.95 |
| ADORA2A | SEQ ID NO: 403 | cg15499799 | 0.003 | 4.44 | 72.14 | 0.001 | 1.69 |
| ADORA2A | SEQ ID NO: 404 | cg26354221 | 0.004 | 4.91 | 68.00 | 0.001 | 2.04 |
| ADORA2A | SEQ ID NO: 405 | cg25786366 | 0.009 | 4.94 | 28.00 | 0.022 | 1.48 |
| ADORA2A | SEQ ID NO: 406 | cg27381549 | 0.014 | 9.53 | 83.50 | 0.044 | 1.41 |
| ADORA2A | SEQ ID NO: 407 | cg19855777 | 0.048 | 4.23 | 54.16 | 0.012 | 1.89 |
| BTNL2 | SEQ ID NO: 408 | cg01954567 | 0.003 | 6.06 | 60.00 | 0.009 | 1.76 |

TABLE 1-continued

Results of overall survival analysis of 528 patients with squamous cell carcinoma of the head and neck area. The relationship between DNA methylation of the listed genes and the survival of the patients was investigated. For the genes listed several times in the table, the methylation analysis according to the present invention was carried out with the specified bead pairs covering different areas of the corresponding gene. These regions are identified by the sequence with the respective SEQ ID NO. Hazard ratio 1 refers to the methylation value without previous dichotomization, hazard ratio 2 describes the relatively higher risk of patients with methylation values above the threshold to die compared to patients with values below the threshold. The p-values 1 and 2 refer to the respective hazard ratios 1 and 2.

| Gene | SEQ ID NO | Bead-Pair | p-value 1 | Hazard Ratio 1 | Threshold value | p-value 2 | Hazard Ratio 2 |
|---|---|---|---|---|---|---|---|
| BTNL2 | SEQ ID NO: 409 | cg18551048 | 0.010 | 3.99 | 84.28 | <0.001 | 1.91 |
| BTNL2 | SEQ ID NO: 410 | cg24865122 | 0.012 | 15.39 | 78.29 | 0.001 | 2.10 |
| BTNL2 | SEQ ID NO: 411 | cg16487292 | 0.017 | 7.19 | 92.06 | 0.006 | 1.60 |
| BTNL2 | SEQ ID NO: 412 | cg22707857 | 0.022 | 17.37 | 9.61 | 0.001 | 1.72 |
| BTNL2 | SEQ ID NO: 413 | cg06557067 | 0.025 | 29.70 | 88.30 | 0.018 | 1.67 |
| BTNL2 | SEQ ID NO: 414 | cg03036047 | 0.028 | 3.66 | 78.80 | 0.023 | 1.57 |
| BTNL2 | SEQ ID NO: 415 | cg13979407 | 0.034 | 4.42 | 87.00 | 0.013 | 1.61 |
| BTNL2 | SEQ ID NO: 416 | cg26122998 | 0.036 | 1613 | 4.59 | 0.001 | 1.75 |
| BTNL2 | SEQ ID NO: 417 | cg23083776 | 0.044 | 18.21 | 9.15 | 0.026 | 1.65 |
| BTNL2 | SEQ ID NO: 418 | cg06259800 | 0.046 | 3.98 | 70.00 | 0.044 | 1.43 |
| BTNL2 | SEQ ID NO: 419 | cg04970287 | 0.047 | 2.17 | 75.00 | 0.039 | 1.39 |
| BTNL2 | SEQ ID NO: 420 | cg14945317 | 0.048 | 18.87 | 95.10 | 0.037 | 1.42 |
| BTNL2 | SEQ ID NO: 421 | cg11334097 | 0.049 | 2.14 | 67.84 | 0.004 | 1.61 |
| C10orf54 | SEQ ID NO: 422 | cg17411913 | 0.003 | <0.01 | 3.95 | <0.001 | 0.52 |
| C10orf54 | SEQ ID NO: 423 | cg14522427 | 0.017 | <0.01 | 1.33 | 0.023 | 0.69 |
| CD160 | SEQ ID NO: 424 | cg20975414 | 0.004 | 4.61 | 38.14 | 0.003 | 1.91 |
| CD160 | SEQ ID NO: 151 | cg10798745 | 0.040 | 2.95 | 61.00 | 0.017 | 1.52 |
| CD27 | SEQ ID NO: 71 | cg11384427 | 0.019 | 7.91 | 69.50 | 0.045 | 1.90 |
| CD274 | SEQ ID NO: 425 | cg23598352 | 0.012 | 0.23 | 75.00 | 0.024 | 0.69 |
| CD274 | SEQ ID NO: 426 | cg14025883 | 0.027 | 0.17 | 72.39 | <0.001 | 0.57 |
| CD276 | SEQ ID NO: 427 | cg20856453 | 0.007 | <0.01 | 2.97 | 0.003 | 0.59 |
| CD276 | SEQ ID NO: 428 | cg15484899 | 0.008 | <0.01 | 6.08 | <0.001 | 0.53 |
| CD276 | SEQ ID NO: 429 | cg10586317 | 0.021 | 0.11 | 30.70 | 0.004 | 0.58 |
| CD276 | SEQ ID NO: 430 | cg24779170 | 0.047 | 3.01 | 58.10 | 0.015 | 1.50 |
| CD48 | SEQ ID NO: 431 | cg16909402 | 0.011 | 3.27 | 46.00 | 0.005 | 1.63 |
| CD48 | SEQ ID NO: 432 | cg24154340 | 0.027 | 2.70 | 32.24 | 0.007 | 1.69 |
| CD48 | SEQ ID NO: 433 | cg05200628 | 0.041 | 2.15 | 40.00 | 0.006 | 1.96 |
| CD80 | SEQ ID NO: 434 | cg06045968 | 0.001 | 7.10 | 51.65 | <0.001 | 1.91 |
| CD80 | SEQ ID NO: 127 | cg13458803 | 0.002 | 4.96 | 69.66 | <0.001 | 1.96 |
| CD80 | SEQ ID NO: 435 | cg06300880 | 0.015 | 2.95 | 66.07 | <0.001 | 2.26 |
| CD80 | SEQ ID NO: 436 | cg21572897 | 0.016 | 3.27 | 68.36 | 0.002 | 1.68 |
| CD80 | SEQ ID NO: 126 | cg12978275 | 0.019 | 6.61 | 82.32 | <0.001 | 1.84 |
| CD86 | SEQ ID NO: 437 | cg11874272 | 0.004 | 3.76 | 75.00 | 0.041 | 1.40 |
| CD86 | SEQ ID NO: 438 | cg16331599 | 0.010 | 2.79 | 52.66 | 0.003 | 1.65 |
| CD86 | SEQ ID NO: 439 | cg09644952 | 0.029 | 3.11 | 52.76 | <0.001 | 2.11 |
| CD86 | SEQ ID NO: 440 | cg01436254 | 0.036 | 2.81 | 56.08 | 0.001 | 2.00 |
| CD86 | SEQ ID NO: 441 | cg04387658 | 0.038 | 6.28 | 73.21 | 0.010 | 1.65 |
| CD86 | SEQ ID NO: 442 | cg18995097 | 0.049 | 9.79 | 65.58 | 0.012 | 1.50 |
| ICOSLG | SEQ ID NO: 443 | cg13053992 | 0.032 | 4.44 | 40.14 | 0.026 | 6.81 |
| KIR2DL4 | SEQ ID NO: 444 | cg24838349 | 0.008 | 0.20 | 47.50 | 0.025 | 0.66 |
| PDCD1 | SEQ ID NO: 445 | cg09031938 | <0.001 | 45.17 | 76.00 | <0.001 | 1.89 |
| PDCD1 | SEQ ID NO: 369 | cg27051683 | <0.001 | 29.28 | 35.00 | 0.003 | 1.63 |
| PDCD1 | SEQ ID NO: 23 | cg17322655 | <0.001 | 10.93 | 33.00 | <0.001 | 1.84 |
| PDCD1 | SEQ ID NO: 24 | cg20805133 | <0.001 | 15.33 | 6.18 | 0.001 | 2.05 |
| PDCD1 | SEQ ID NO: 20 | cg00795812 | <0.001 | 30.72 | 33.16 | <0.001 | 2.29 |
| PDCD1 | SEQ ID NO: 22 | cg03889044 | <0.001 | 37.23 | 30.00 | <0.001 | 1.81 |
| PDCD1 | SEQ ID NO: 446 | cg16873443 | 0.001 | 4.64 | 35.64 | <0.001 | 1.97 |
| PDCD1 | SEQ ID NO: 447 | cg14453145 | 0.001 | 4.92 | 53.80 | <0.001 | 1.86 |
| PDCD1 | SEQ ID NO: 448 | cg18096388 | 0.002 | 23.75 | 35.70 | <0.001 | 2.03 |
| PDCD1 | SEQ ID NO: 449 | cg10057601 | 0.004 | 5.81 | 74.34 | <0.001 | 2.25 |
| PDCD1 | SEQ ID NO: 450 | cg25372407 | 0.005 | 4.27 | 77.66 | <0.001 | 1.92 |
| PDCD1 | SEQ ID NO: 451 | cg01889010 | 0.006 | 5.02 | 60.62 | <0.001 | 2.07 |
| PDCD1 | SEQ ID NO: 452 | cg02122525 | 0.006 | 4.86 | 24.50 | 0.022 | 1.51 |
| PDCD1 | SEQ ID NO: 453 | cg06386983 | 0.011 | 4.17 | 23.32 | 0.001 | 2.47 |
| PDCD1 | SEQ ID NO: 454 | cg16720890 | 0.011 | 4.89 | 75.78 | 0.003 | 2.41 |
| PDCD1 | SEQ ID NO: 455 | cg11036279 | 0.012 | 4.64 | 29.00 | 0.003 | 1.70 |
| PDCD1 | SEQ ID NO: 456 | cg03903296 | 0.013 | 5.07 | 62.32 | 0.001 | 1.74 |
| PDCD1 | SEQ ID NO: 457 | cg09319815 | 0.016 | 3.27 | 89.48 | 0.001 | 1.68 |
| PDCD1 | SEQ ID NO: 458 | cg15153118 | 0.018 | 3.69 | 67.60 | <0.001 | 1.79 |
| PDCD1 | SEQ ID NO: 459 | cg25890838 | 0.018 | 6.66 | 39.00 | 0.008 | 1.55 |
| PDCD1 | SEQ ID NO: 460 | cg21855211 | 0.021 | 2.76 | 10.70 | 0.018 | 1.51 |
| PDCD1 | SEQ ID NO: 461 | cg24984297 | 0.022 | 4.92 | 68.31 | 0.002 | 1.67 |
| PDCD1 | SEQ ID NO: 462 | cg11532131 | 0.029 | 3.70 | 68.79 | <0.001 | 1.83 |
| TIGIT | SEQ ID NO: 463 | cg22870429 | <0.001 | 10.11 | 39.17 | 0.001 | 1.90 |
| TIGIT | SEQ ID NO: 464 | cg19421218 | 0.005 | 3.19 | 37.00 | 0.005 | 1.63 |
| TIGIT | SEQ ID NO: 465 | cg20832020 | 0.019 | 2.92 | 47.50 | 0.006 | 1.56 |
| TIGIT | SEQ ID NO: 466 | cg22577252 | 0.033 | 3.04 | 40.92 | 0.004 | 1.59 |

TABLE 1-continued

Results of overall survival analysis of 528 patients with squamous cell carcinoma of the head and neck area. The relationship between DNA methylation of the listed genes and the survival of the patients was investigated. For the genes listed several times in the table, the methylation analysis according to the present invention was carried out with the specified bead pairs covering different areas of the corresponding gene. These regions are identified by the sequence with the respective SEQ ID NO. Hazard ratio 1 refers to the methylation value without previous dichotomization, hazard ratio 2 describes the relatively higher risk of patients with methylation values above the threshold to die compared to patients with values below the threshold. The p-values 1 and 2 refer to the respective hazard ratios 1 and 2.

| Gene | SEQ ID NO | Bead-Pair | p-value 1 | Hazard Ratio 1 | Threshold value | p-value 2 | Hazard Ratio 2 |
|---|---|---|---|---|---|---|---|
| TNFRSF18 | SEQ ID NO: 472 | cg25725823 | <0.001 | 10.95 | 20.00 | 0.011 | 1.51 |
| TNFRSF18 | SEQ ID NO: 473 | cg15706223 | <0.001 | 17.21 | 10.50 | 0.004 | 1.64 |
| TNFRSF18 | SEQ ID NO: 474 | cg04343794 | <0.001 | 12.56 | 10.00 | 0.011 | 1.59 |
| TNFRSF18 | SEQ ID NO: 475 | cg07671976 | <0.001 | 30.62 | 7.50 | 0.008 | 1.55 |
| TNFRSF18 | SEQ ID NO: 476 | cg14886269 | 0.001 | 7.52 | 5.00 | 0.006 | 1.63 |
| TNFRSF18 | SEQ ID NO: 68 | cg08641866 | 0.003 | 9.11 | 5.00 | 0.012 | 1.55 |
| TNFRSF18 | SEQ ID NO: 477 | cg02709725 | 0.022 | 12.01 | 37.51 | 0.004 | 1.68 |
| TNFRSF18 | SEQ ID NO: 478 | cg00086243 | 0.024 | 8.70 | 19.90 | 0.002 | 1.64 |
| TNFRSF25 | SEQ ID NO: 157 | cg00087884 | 0.032 | 8.08 | 44.90 | 0.025 | 1.58 |
| TNFRSF4 | SEQ ID NO: 479 | cg21616720 | 0.002 | 5.75 | 73.14 | <0.001 | 1.89 |
| TNFRSF4 | SEQ ID NO: 480 | cg23867494 | 0.005 | 5.68 | 40.19 | 0.004 | 1.82 |
| TNFRSF4 | SEQ ID NO: 481 | cg16252905 | 0.013 | 10.00 | 62.02 | 0.002 | 2.28 |
| TNFRSF4 | SEQ ID NO: 482 | cg09586191 | 0.015 | 12.76 | 82.62 | 0.008 | 1.53 |
| TNFRSF4 | SEQ ID NO: 483 | cg17084044 | 0.028 | 3.87 | 42.58 | 0.017 | 1.65 |
| TNFRSF4 | SEQ ID NO: 484 | cg21815220 | 0.033 | 6.72 | 45.00 | 0.047 | 1.38 |
| TNFRSF9 | SEQ ID NO: 59 | cg08840010 | 0.029 | 2.68 | 52.60 | 0.003 | 1.68 |

Table 2 shows by way of example of the immunoregulatory genes mentioned above that mRNA expression analysis of these genes can also predict patient survival and thus complement DNA methylation analysis in accordance with the invention. Patients were grouped according to an exemplary threshold value. This threshold value is the number of mRNA molecules of the immune checkpoint in relation to all mRNA molecules analyzed by RNA-Seq (normalized count), on the basis of which the patients could be particularly well divided into a group with a good prognosis and a group with a poor prognosis.

Patients who showed an mRNA expression of CD274 or CD276 above the respective threshold in the tumor exhibited a significantly less favorable course of the disease than patients whose tumors expressed these genes below the respective threshold. For the genes ADORA2a, BTNL2, C10orf54, CD160, CD27, CD48, PDCD1, TIGIT, TNFRSF18, TNFRSF25 and TNFRSF4, patients whose tumors expressed the gene above the respective threshold had a more favorable prognosis. Using this example, it could be demonstrated that mRNA expression analysis can be used as an additional reliable indicator for the determination of the prognosis according to the present invention.

TABLE 2

Results of the overall survival analysis of 528 patients with squamous cell carcinoma of the head and neck area. The relationship between the mRNA expression of the listed immunoregulatory genes and the survival of the patients was investigated. The hazard ratio was determined on the basis of a mRNA expression value that was dichotomized using the specified threshold value.

| Gene | Threshold | p-value | Hazard Ratio |
|---|---|---|---|
| ADORA2A | 87.2 | 0.003 | 0.60 |
| BTNL2 | 0.45 | 0.049 | 0.58 |
| C10orf54 | 1015 | 0.096 | 0.73 |
| CD160 | 11.78 | 0.002 | 0.42 |
| CD27 | 108.1 | <0.001 | 0.54 |
| CD274 | 127.0 | 0.015 | 1.50 |

TABLE 2-continued

Results of the overall survival analysis of 528 patients with squamous cell carcinoma of the head and neck area. The relationship between the mRNA expression of the listed immunoregulatory genes and the survival of the patients was investigated. The hazard ratio was determined on the basis of a mRNA expression value that was dichotomized using the specified threshold value.

| Gene | Threshold | p-value | Hazard Ratio |
|---|---|---|---|
| CD276 | 3944 | 0.004 | 1.59 |
| CD48 | 270 | 0.018 | 0.63 |
| PDCD1 | 48.2 | 0.021 | 0.68 |
| TIGIT | 100 | 0.010 | 0.65 |
| TNFRSF18 | 250 | 0.018 | 0.68 |
| TNFRSF25 | 250 | 0.041 | 0.69 |
| TNFRSF4 | 57.32 | <0.001 | 0.48 |

Example 19: Determination of DNA Methylation and mRNA Expression Using Co-Methylation and Co-Expression of Immunoregulatory Genes As already demonstrated in Example 8, immunoregulatory genes are often co-expressed, i.e. cells of a malignant disease and/or immune cells such as T lymphocytes not only express a single immunoregulatory gene, but several immunoregulatory genes are expressed simultaneously. In this experiment, mRNA expression and DNA methylation of different immunoregulatory genes were determined as described in Examples 1 and 6. The mRNA expression data were generated for 520 and the DNA methylation data for 528 head and neck tumor patient samples.

Table 3 shows that for the immunoregulatory genes listed as examples there is a statistically significant and positive correlation of the mRNA expression of different immunoregulatory genes in the tumors. Thus, by determining the mRNA expression of one or more immunoregulatory genes, it is possible to deduce the mRNA expression of other immunoregulatory genes as well.

TABLE 3

Spearman rank correlation (Spearman's ρ) of mRNA expression of different immunoregulatory genes in tumors of 520 head and neck cancer patients. All correlations had a significance level of $p < 0.001$, except the correlation of ICOSLG and CD274 ($p = 0.008$) and the correlation of ICOSLG and PDCD1LG2 ($p = 0.070$).

|         | PDCD1LG2 | PDCD1 | CD80 | CTLA4 | ICOSLG | ICOS | LAG3 | KIR2DL4 |
|---------|----------|-------|------|-------|--------|------|------|---------|
| CD274   | 0.75     | 0.51  | 0.58 | 0.47  | 0.11   | 0.53 | 0.52 | 0.48    |
| PDCD1LG2 |         | 0.48  | 0.70 | 0.55  | 0.08   | 0.64 | 0.54 | 0.41    |
| PDCD1   |          |       | 0.64 | 0.82  | 0.38   | 0.80 | 0.88 | 0.69    |
| CD80    |          |       |      | 0.77  | 0.28   | 0.83 | 0.68 | 0.44    |
| CTLA4   |          |       |      |       | 0.31   | 0.91 | 0.81 | 0.55    |
| ICOSLG  |          |       |      |       |        | 0.37 | 0.28 | 0.21    |
| ICOS    |          |       |      |       |        |      | 0.79 | 0.55    |
| LAG3    |          |       |      |       |        |      |      | 0.71    |
| KIR2DL4 |          |       |      |       |        |      |      |         |
| CD40    |          |       |      |       |        |      |      |         |
| CD160   |          |       |      |       |        |      |      |         |
| KIR3DL1 |          |       |      |       |        |      |      |         |
| CD27    |          |       |      |       |        |      |      |         |
| TIGIT   |          |       |      |       |        |      |      |         |
| BTLA    |          |       |      |       |        |      |      |         |

|          | CD40 | CD160 | KIR3DL1 | CD27 | TIGIT | BTLA | HAVCR2 |
|----------|------|-------|---------|------|-------|------|--------|
| CD274    | 0.23 | 0.16  | 0.30    | 0.33 | 0.53  | 0.41 | 0.52   |
| PDCD1LG2 | 0.26 | 0.17  | 0.26    | 0.35 | 0.52  | 0.41 | 0.65   |
| PDCD1    | 0.51 | 0.43  | 0.47    | 0.84 | 0.90  | 0.79 | 0.78   |
| CD80     | 0.45 | 0.19  | 0.27    | 0.55 | 0.73  | 0.61 | 0.83   |
| CTLA4    | 0.51 | 0.39  | 0.37    | 0.76 | 0.85  | 0.73 | 0.78   |
| ICOSLG   | 0.28 | 0.16  | 0.21    | 0.43 | 0.42  | 0.41 | 0.37   |
| ICOS     | 0.48 | 0.32  | 0.38    | 0.76 | 0.89  | 0.77 | 0.79   |
| LAG3     | 0.52 | 0.38  | 0.41    | 0.73 | 0.83  | 0.64 | 0.77   |
| KIR2DL4  | 0.34 | 0.33  | 0.50    | 0.53 | 0.67  | 0.61 | 0.53   |
| CD40     |      | 0.33  | 0.22    | 0.44 | 0.49  | 0.43 | 0.48   |
| CD160    |      |       | 0.27    | 0.42 | 0.39  | 0.45 | 0.35   |
| KIR3DL1  |      |       |         | 0.44 | 0.47  | 0.45 | 0.38   |
| CD27     |      |       |         |      | 0.86  | 0.86 | 0.68   |
| TIGIT    |      |       |         |      |       | 0.84 | 0.82   |
| BTLA     |      |       |         |      |       |      | 0.70   |

PDCD1LG2 and CD274 encode ligands that both bind to the receptor encoded by the PDCD1 gene. For these genes, the correlation of DNA methylation was investigated. For the DNA methylation analysis of PDCD1LG2 the bead pair cg07211259 (SEQ ID NO:31) and for CD274 the bead pairs cg15837913 (SEQ ID NO:8), cg13474877 (SEQ ID NO:11), and cg19724470 (SEQ ID NO:12) were used. The correlation was determined using a Spearman rank correlation and the correlation coefficient was presented as Spearman's ρ. The statistical significance is expressed as a p-value. The result of bead pair cg07211259 correlated with bead pair cg15837913 (ρ=0.33, p<0.001), cg07211259 with cg13474877 (ρ=0.24, p<0.001), and cg07211259 with cg19724470 (ρ=0.42, p<0.001). Based on the correlation found, the results demonstrate that for instance DNA methylation analysis of PDCD1LG2 can be used to draw conclusions about the methylation of CD274. In this way, a DNA methylation analysis of PDCD1LG2, for example, can be used to predict the response to therapy with a drug that inhibits the immune checkpoint encoded by CD274 or PDCD1, e.g. if the DNA methylation analysis of PDCD1LG2, according to the correlation found, indicates a specific DNA methylation for CD274 that makes the response to therapy with the drug likely.

SEQUENCE LISTING (485 sequences)

SEQ ID NO: 1 - DNA, 20064 bp, Homo sapiens
  coding Sequence of the CD274 Gene
ggcgcaacgctgagcagctggcgcgtcccgcgcggccccagttctgcgcagcttcccgaggctccgcaccagccgcgcttctgtccgcctgcaggtagggagcgttgttcctccgcgggtgcccacggcccagtatctctggctagctcgctgggcactttaggacggagggtctctacaccctttctttgggatggagagaggagaagggaaagggaacgcgatggtctagggggcagtagagccaattacctgttggggttaataagaacaggcaatgcatctggccttcctccaggcgcgattcagttttgctctaaaaataatttatacctctaaaaataaataagataggtagtataggataggtagtcattcttatgcgactgtgtgttcagaatatagctctgatgctaggctggaggtctggacacgggtccaagtccaccgccagctgcttgctagtaacatgacttgtgtaagttatcccagctgcagcatctaagtaagtctcttcctgcgctaagcaggtccaggatccctgaacggaatttatttgctctgtccattctgagaacccaaaggagtcctaaaagaggaatggaggagcctaagaataaaaatagtataataaaacatttcttagacacattgaccttggcctatgtcaaagttcagtctgggtttgtcttataacacaaggagtaaaagtaccattgttctacctctttttttaatacttgaaaaaaatttactgtggatgcttttctatgaattaaataaccttctaaaaaatgttttcattgctgcattcgattagattgggtaactaaatgaaattaattcctcactgttgggtataaaggttatttacagtggttctgtcttagccattcactgaactcattgcatatatatctctggaatattgctgattgtttccttcaagtaaacttagaagtgtaactacttagtcaaagagcctgaatattttaaaggccttttgaagaaaactgaaaatgctttccagaaaggatgtatcagttgacaatgacagtcgtcaacagtatttaaggagaactatgatactctgaagaaaaacttagcctttctcagtaaaagtaggtaggcagaggccacatgacagcagttagagtgtggtcttcaaggaagtcacagaaatactgtggggaattgaaaccccatgtggaaaatgtacaagagtgtctcagtgtgactgagaaggaggttgggcatggggtttcatggagtttaataaagtttggtcacttagtagaggtttaataaatcaactgtcttaatctttgatcctacttaagaattttttttttgtttttgtagagatggggctcttgttatgttgcccaggctgttctcgaactcctagcctcaggcgatcctccctcctcaggctccagaagtcctgggattactggcgggagccaccatgcaggcctcttgctcctacttttgagaaaggaagtttaaccggttttttttgtctttttttttttttttttgagacagagtctcactctgttgcccatgctggagtgcagtggtgcaatctcagctcactgcctcccgggttcaagtgattctcctgcctcagcctcccgagtagctgggactacaggcacctgccaccacgcccagctaatttttgtatttttagtagaaatggggtttcaccatattggccaggctgatctcgaactcctgacctcaggtgatccgcctgcctcggcctcccaaagtgctgggattacaggcatgagccactgctcctggctgcttaactttttctctatctcatcctcctacccatcctacccttggaagatagagaagtagtattagttccatagtgttatactgggcttcccccagggacaaacccacttccccaacctgaatgagccatcacttcttccccagtttacatttcattgctctttaaatgtctccattcggatatgggaattcacatatggtcataattcttacctgaagaagatgtcagtcttcttctcttagaccaactgccctgatatgaggtttagaggttaaagaacatgtgtgtatttacatgatctttgtattctgccttttcgtccctcactaatgacagctgcaccccaaggaaatggagctgtggaagagagggtttgataagaaattaagtaaatattggatctaatccatcaccctccaggaagcctttattactcctaaaaatttcaaccaaattcattaaaggacaagaactccaccagagtaggccataaacattggcaaaattagttgtaatccatgactagatttaatgtccctttgttttattcccatatggttataatgctttgcttggcattaggggtattttaagttttcttctgcctagtaagtgaatttgtgtttataatacaataatcataaaatatcacattaatattttataactgtacagttataaaatattttataagtaatatttatattttataagtaatattttataactgtacagttaactctggcccaaggaaaagatagtctgatagatgctgcagccccattttagcaaatgtgacctcacaggcctgaatgccatcgctattccacatctacaggatagacggaaaggaaagaaataaaaaaataggtacctaacactggcaagaggatgatgactcatgttatttcacttaacctttttatcttttaacatgaaggactcatacaggttgataagaaaccagtgacataaacagaccaaaaaatgatcagatctttcaaattagcaaaaaaataatattttttaaacaatgggtgaaaatacagtgtaacagtaccaattatcaacatgtgttgagaaccagaaaaatgttctttttctttgatcagcaacactatttgggaaaatctatcctcagggcctagcctggggccctggcacacagtaggcactcaacgaatatttgctgaacacacaaatacttatgatattttaaaaaattggcaacaatctgatacctaacaatagagggattaaatattatggaactgttaaataagatgcttatgaataccatgcagtaagatgggcaatatttatgccataagctttaatgaaacaaatgggtattaaatgtatgataaggttataaattactttttaaaagattacagggaaaaaaattgaaagatatacactgaaatgttttttgctcacagtggtgacaaggtttctcagcactggcactgttgacgttttaggctgtatgtctttgctgtgggaggctggcctgtgcactgcagggtgtttggcagcactcttggcctctgcccctagatagcaatagcagtcctccctcaaccagcccaattttgacaaccaaaaatgtttccaggcatcaccagatgctccctgggtgagagtgatgaaatagtaggggattttccccttcttttcttattttctgtaattccattatattactttaataataaagaaaaaaacataaaaaataaacgaatgttattattctacgtcagtttggatgtttggactccattttggggttctttccattatatcacttggtctgctaaacattctacggtttggtaaggtgaagtgattcatgaaattttggttttatttttttcctgatactaaaaataaaacattctttcacttggaaatttggacacagaacaccaaaaaaaatccataatctcatctctctttttctgtcttttccttccttttttccctttaaaaacaataaagagtgaaacctacctgttctccctctaatttaattcctaaatataatcactgtcaatatcttggacatttcctgtgtctaaacacacacacacacttttttttttcagcaaaagtggatttctgctacatgtagtgttctgcaacttactttctatgtgtttacaaaatcagtacatgtacatatgctgaattcagtccttaatggtattatattttgtgaatataccaaaatttgtttaaccacttagacaatctaggatattctcagtttgctgttatgagcaatgctcttcctttacatatacagacatatatatatatatgtgtgtgtgtgtgtttttgttttagtaggatagatttctaggagagggtgaaaggtcttatgacatccgcatttacgattgtaataggaagtatcaaagtgccccctaaagaaaaaaatcctcccattagtgggtaagaaagcctatttgttcatatcttcacaaacactaaatattagaaatatttacaattgtggtcaagctcataagtgaaaatggtatttcatatcttatattttttattgtgagattgaacatctttcatatgtttacatgtcacctgtatttcttattctctgaactatatgttatgacctttcactttttttcctcatgggttatgtgtagtttgtatagttgtcttattgattgttaggagctatttatatattaggaacattaatctcctgtcttatatatacgtggcatcgattagttgatcatttgtgagttcatgtctgtatacaaagattggagaggcactaagagggaaaacttacctctttcttatcaaagtttgtaaatatatgtataacagaagagggagaaaatattaataaatgcacagattggctgaaatagagtataaatcttttactcccctacttcaacataaactgcaaaaggagagtgacttttctttcactctgacttccgtattcctcatgcttaaaatagtgcctagcacagaagaggtgctcaatcagtgtttgctaaacgaaataattagtcacatttcaagcaggatgactaaatgaagaatagaatctaggcagatactctggaagagtggctgtgagtcattcatatcttagtatgaattagtcaaatccaactctctccccttcccactccccactgttagtagaagaatctgtttattgagagaatagatttataatttagaataagtgagaggggcagaagaggagattttgaaggatggcacctgaaggaggactagcatggctgagacagtgaagtggaagccttgaatagctaaagggtaagatgaaagtatttagctgtagggggaaaaagcattgacaggttggaaaagtaaaagtcagattctccttgctctgaaattttgtacagggcaggttctactaggtatgttacaatgcagaaaaaacatgaaataattgagaggaatttggtgcaatattatcttcttggcttcttttgagtgggcagatttttttcacggcctgtaactataataaatttgaaacttctcatcttttagtaacttttttcacttaagtttatgtggctgtgggcaatggaatgaagatattgaacttccaattccctgttgggtttccacaattacaagtcaatcatgactggttattagaagactatttcagttagaaccaccaagtcccatattgtcatattgtatgtttaattattaagtgaagcagtcttcttttcgtgttttccataattagggcattccagaaagatgaggatatttgctgtctttatattcatgacctactggcatttgctgaacggtaagacaccaaatccttccattaggttctatattttaaatattttaaccatgagtttaaaactaaaatgatcatttaaaatgcatgcaattttcttatagagagaacattctattctttcttctactttacacaatggcaaagtcttctttctactttacgcaatgataaagttacctgtgtcattttgtaaaaatatagagaatatagacaaattgaaagacacaaaataatctattacccatttcccagggttaactactgaaaatatctggggaaatggcctgtatgtatacatttatttgtttgctttcaacaaggccaagatcctttgatctttcagtcttggttgctctgtgacatgcctttcctgatgaggatactttaaggaagaattgtaagatacatggaaaatgtcaggctaacacagtactggcatcaccctgtgctctttcctgaactccataccaatgtacttcttgccagaaaactgatcaaaagtttagggaagtaaaaagagatgactgttagaatctaccattccctctatgtaggaagcaaataggtgtcctgtcaaaggacattctggggatgtctacatgaaaccaagtctccctggttgtaaggactccatctccatataatatttatacagtaatatatgtttataaattgtgggggcaacttgtttagctaattttattattctgctattgggacactgtgtctcagcatgagatatagtgtcccaaaacatatttcaagcccattggataaaatatgtgtttagcaagttcttaaatataatgataacataaccgaccagataaagtgatttataaacgctgtgccaattttgtaaatgtttcgaggaattttcccttttctgaagattgtccttctttctttttagcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatggtaagaattattatagatgagaggcctgatctttattgaaaacatattccaagtgttgaagacttttcattcttgtaagtccatacttattttcaaacagaacagcatagtctgttcattcattcattcaattcatgaattcattcacataattatccaatttcttgagcacctatttgatagtcactggaaatccagagacaaacaacacagagccatgttctacagtatgtacagttttccaaaaagaatttctagtctttacttttttattacaaatggaatacgtatacttgcaaataattcagatactgtggaagagatcaaatgaattgcaaaagtgtccctcctcccttcaccactatctcccatggcatgcagagagagtaaccattatttgtgtgtccctccagaaatttttttattcaactactatttttttattttattaggtccgtcagttttccttttttgagcctctctatatcaaatgcaaataaatatattcagaacaaaccccactgtaaggttcacattaaaaaagacttgaagtcaccctatgaagacaaaaaataatcacattaagtgtgaaagaacctattcttccagtacaggataagccatacttactgggcatatattcatcttgaaaatctatactgatgttgtcttggggaattgaaaaggaactaggagtgttagttcctcggtattgacccacagttatgttatcaggtcacttgagttcaaagttttgtgttggcactagctaagtaaaggaaaacacctctgctttcattgttgagtttcacagaattgagagctgaaaggatcccaggcaggagcagctaatccaaactcccacaaagaacaaaaatcccccagaggatcttctgttcttatatttcctgcaatggcgtccctgtcatatcccacaatggcctccctgccatttggatatcccttccatatcctgttgaaattactccctaatagtaagctgaaatctgcccctctagttgtagtcttgggattatttcatttacatgatgaccttttaatatttgactagaattaaatcatctccccttggtctttccattcctgggctaactaccatcaatctgagggctaacaatacaagtagaaaaagtatacatttgtcactgatcactgatcaattattaatcaatgatcactgataactataaactcaaaaacaaaatcatgtggggattaagagaaatgtatcagttttatgttgtatttctggtccctgatactggctcaggtaatgccactattgtcaagaagataccacttgtaaagtagatttaattttcattatattttaccatatgcttctccattcatgacatctcttgagatgttgtggtttatactttcagtttttctccagtccatccgcaaatatcaggcatctactgtgttccaagatattaaagaaatcatcatgacttagcctcatcaacagcattgctagatctgggatggaaaggaagagtataatcctggcagtcaggaagaaggcagcataaagtataagtttctgcttccaaaaaaggtctctcatcagcctgtagggagtgtgtagggaagggacagctgtccttgtagtagggaagggttttattcaggtcgtctgggctccataatatcccttgtgtatctgcagtctcctttgccatggatcaacacaataggaaatcttccggcactgatggtttttccaagggggagttcttcctggagcaaagcaaatgaccaaccaggtttgaggacctgatttgtttgacaattccattttgtattgtaaattacttaattggcattctactcccaatccatcttgtcatttgcatacagtggttttgggattgagttcagctataccaaaagtctgaaccttctgcacttagaacaaggcaaccaccaagcttcacttgcactgaggccgtgtctccaatggaaatgaggcagctggcttgcaggagcttcccaactcagggaagtagaactcctgagtcacctccatatgcaaatgatttcacagtaatgctgttgaacttcacttcccatcacagcaaatgtgtggtaacatagcttccccacaggagtttactcaccatggtattttaaaggtgaaacatttcaaaactgaaatttgaaagaatttagttttggattcactcaattatcactatcacttcgggtgttattgcacctttcttgtttgtgagtttaaatgccagactctcaggccactaactttcaattaaaagtgtttttctttaatcgctgaacctaacagcagggaaaacgaaatgttcattcagactttcagaaccttcaatgagattaggcagctgaaagatcaaagtgttgcatagttgtcccgataaagctatttggatcatatggaccaaatcgactgctgtcattccccaccaaccccatctctccccaaaattcccagccctgtttaagtgttctctgtagcatttatctctatctagtatattgtgtagcatatcatatcatacttttctgttttgtttattgtctctctcctcctagaatataaactccacaagcacaaagatttgggcctgttttataatattgttgcatccccagggcctgatatacagcagagtggtggtacgaaaagagcacacaaaaaaatatttgttgagtcaatgaatgaatgatttcctcaaataggattagcctaaaattttggaaacatgaacagatttggatatgtgaaaatttatttccagactgttcatcaggaactgttagcagcttctaaagggtacactggagcagcagtagtaaaaggaggaagaggagcagctctgctactgctactatcgagtactactacaattagcacttgcttattctgtgtgttaggccctgtactgaacactctgtctaaattagttcatttcctcctggaaatgactctagggggtaagtgcttcatcatgtaagatgagtatttttcacattttgttgtgtctgaaatctgagtgtgtctttcaatgatggaatctttgattccatgataagtggtattattcccattttaaggatgaggaaactgaggtccaaagaaattaagtaatttgcccaaattcacccagcctagaaaatgataaagctagttctaaacccaagcagattagctctgaagtctgggcccttaataaccactttttattgcctatatttgtacctctggtgtacgtatcaagttatatgttgacttcaaaactatcatgaccttttcttggttttgattgtccaacattagtatagtgttctgggtctgcaaaaattttgattactcatctcatctgtaaaacattttgaactcgtgtgtttgtgcatgcacatttgtgtgtaattataaaaattttactttctgttaatatataagttgtatcataagaaactgccgtttttgaagagcaaaaaaaggttgaatgttaccagttacatctggttcaacctaatagacatttgtacaaaaacagacattttaagaggttgaaataaaaatttaataaacaatattttcagtttttactaattgtgatgcttcactatcattagctaatatgtcaaggcataatataccttagggtgaactttatcattaacaaaggtggatggtgtcaataatcttgaggtttgtgtttttttatataacactgcgaggtctaattaagtacttactgtttaccacctcatacagtggccgataaaaagtgtcacttctgctgtttcctctgggttgtgcttgaattattagtattatcttcagtcctcagtttctttgtgggaaactttttaattagttgtttaattttgtaagatggttagtttagtcaaaattagataagagaatttgaaaatccgtagctaccccaaagcaacctacacataagaactattatttttgtgttttgaaatcataattttattgatttccagtgtttccactggtagtggtttcattgatataggagtatcaaaacatcactcattatttatttcagtttcatttgatcctagccgttttgtattaactctctgtgaagaaattacctcacaaatctattgctgtccttggtaaaggaatggagaattaaggctctagatcattagtggttacactatagtattagaagtaaaaaaaagattataccaacaaaataagaacatgttaatgtacttgtaatgaataaacatgaataaagctcttatgctatataggtgcactaaacaatctactagaattgtcagcaaactacgtatcttaatcctgaaagggtcccaaaccaatgatctaaaattgaatcaaactttcttccttgagcataattacttaaatgatttattaaaatagccagcatttaaaagcttaaaatgtaaatatcataatgtggtatcctagatagcatcccagaacagaaaaaggatattagggaaaaactggaggaatggaataaattatgcagtttagttattaataatgtactaacgtccttagttatgacgattgtaccatggtaatgtaagatactaacaatagaggaaaccgggtaaggagtatacagtaactctatactatctttgcaacttttttgtaaatttaaaacttctaaaataaagaacaaatttaaacattaaaaagtatcaccaggaacatatatcactgtttacagatgaaatactatgtattttcatatctaatttctgatcattgacttcaaatcagaaaagtgaatgacacctcaaaatcaggttttctgtttactgaagtctaagaaaagaaagcataccagctggagagattcatgtttataaagacagatttataacaacaaaaataaaatatccaagaataaatttaagaagaagcactttactgagaaacatatgaaaacctgaacaaatggagagggatattttgtatttgaatagaaagacttctggtttaaagataattctctttaaattattttttgtagaaatttaaggggtacaagagcagtgttgtcacatggatatattacatagtggtgaagtctggggttttagtgtaaattaatctttacattttgtttgagcccaataaatgtaccaacatgatttttatagaaagatagtcattcctattaatccaaacttgtcccaactttgaattgaattgaggcagagctagcaggtgttccccacggctgaggcatctgaacattaagcatatccctctgagaaccagcctgcattgatactctttctaatgtggacagcatcaagctatgtacgtagttctgtgctcagcaaaagccctgacttctttttgtttatgtcctagccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataacactatgtttacaaaatatatcctaattcctcacctccattcatccaaaccatattgttacttaataaacattcagcagatatttatggaatataccttttgttccatgcattgtagtactcattggatacacatagaataataagactcagttcacactcttcaggaaacagataaaaaactaagaaacaaacaaaaaacaggcaatccaacaccatgtgggaaatgctttcatagccgggaaacctggggaatacctgagaggaatactcaattcaggccttgtttcaggaatccaaatcctggcacatcagagctgcttccctctttccagggtggcaggaaataaatggaacatatttttctatcttatgccaaacatgagggaccctttctccccggtgcctctcccaaggtagtctacaatatttcaactctagcagtctgcttagtgcatagaacatgaggctgtgtgtccctgggcaaattactagacttctgtgtgcttcactttccctgtaggattataatctactgagcaagcttattgtaagggtcagattagcaacagtgtatgaaaatgatttgagaccattgcctgcacaaattcaactatttttttttatctcactactctacagaagtaggtagggtgggagacagagtctgatgagaggctcagaatgtgaaagaaagtgaggcgagtgagcatgatatttaatataaacacaaagatattctgagaagagctgctcactgccccctcccccaatacatgttgataggaaaatgccacgtacttcagcaaaaacaactgaaaaattagatagaaaagtcaatcaataggaaaagataatccaggacggtgttgtgaacagaaagagggggaaaaaactttagaaaatgatggggatgctcttactggggtacgagtcctcaggtattgaactggctttcagtaaaagctagattagtgggttcctgccatttacaagctgttttatgacaacttacttgttgggtggcctacagtaactcacctaactgcactgagtctgtttcctcatctgtaaattggggatttttttttaaatacctggcatgcctaactcataaagttgttctgaaactgaaataaaacatacgtgaacaggcattgtaaactgtaagttacggaaaaagctggctgttgttgtgtctttaaagtttcacctgggtagtcaaagatggatcatgggtctcagtggagagctgagccaggcaggagctgactaagggtgagaggtgggagttagcagcctctgaacatctgtgtaccatgggaccccctttcctcctgcatggtaccccagacaaggagcctagtaagagatactaatggcttgttgtccagagatgttcaaactgcagagaaagataagacaacaagcattggcctccaatcatgatgacagataggaggaggtgggagctccttagcagtgctggttggccttccatgttctactgtgggccatctctgccatgtactgtaggctactagcttctatattaaagaatgcaagaggggccaggagcggaggctcatgcctgtaatctcagcactttgggaggccaaggtgggcagatcacttgaggtcaggagtttgtgaccagcctggccaacatggtgaaactctgcctttactaaaaatataaaaattagctgggtgtggtggtgtgcacctgtaatcccagctactcgggagactgaggcacaagaattgcttgaacctgggaggcggaagttgcagtgagcccagattgcgccactgcactccaccctgggcaacagagaaagactctgcctcaaaaaaaaaaaaaaaaagcaagaggaagtgaaataatcaaggccgccatttaatagtgagcagccactccatgtggtactgtgcaagcacattataaatattagcctcacaagaaatgtattagcatttgtattttgtacactggttaagtatcttgcccaagacctcaaaactggttaagggcagcagaatttagccccagcaccaccttttcaaagcctgggcttctcacacttctccatgctgttcccattttaacacaggtatctcgccattccagccactcaaactttggcatttaagaaaattatcctaaagctaaactaaacttcaaggatgaccattctcctgaccccttcccatcaaaattttatctttagtcagtttgttttcgttttgttttgtttttcagaactacctctggcacatcctccaaatgaaaggactcacttggtaattctgggagccatcttattatgccttggtgtagcactgacattcatcttccgtttaagaaaaggtagtatttccttaattgcagtggtctccactgggggtgaggaaggggtgagaattggatcatggctgcaaggaaacccgacttaacctctgcaaggtggtgcaaaggcattccactgttcaacagcaattatattgaagctgagtgggatcactgggtgaagatgaagcgtaaggggtgaggggcaggagaatgggtatggatggaggtagaagatgcagtgtcatacagtttttttctatcatgaaaataaccacagacttacagaagagaaagagctaaaatgcccgtcattttcagttgcattttagtcttgcattagttgcaaccagctggtttctgggtaccctaagtaataaaaatagttcctctgtagaactgtagtatgtttaccatagagtattttgcaaaatttttggtagaggatgttacataatttgcatgtgttcatttctccatttacctgtgggaacaattaaaatccaggaaaatgagtatattcaaataatttcctcccatttaagatgagtcagagtaaataattcctccaatacttagagaagtataccaagagatccagtgatggtatagagttgtctgatgttaaatagggaagtagaatatggaaggggattccaatagtcgttgaaaaattccccataaccccttacatgggggaaagtagtgttaactgagagagtagagataagctgtttccaaaaattatattcttaacaggactgagatagccagaatataaggatcaagtttcaatgacagtaagatcctgagatggagttgatttgcacaaagaaataattgttgccagcatgcattttgaatatttctctggaaaaaaagattagttggcagtagaaatggatagaaatcaatagatattaaaatacctcagaatttggttcatctctgggaaaagatgaaaaataaaagtgtatactcctcaagaacatctaggatcaaaagcatgtgccctacactattgaattaattaacctcataagttgggacctgtggaataaggatgtccaccagacttcctagggattacaaatgtttcacagaacttgaaatttaaacttgggtcactgtatgggatgtagagctgtgctatatggaaataaaaatgatttctttttctcaagggagaatgatggatgtgaaaaaatgtggcatccaagatacaaactcaaagaagcaaagtggtaagaatatcagaaggaattgggaagtaaaagtcaaaggaaacaaaaagctaaagcaataacaaagagaaatccatcagtcataatctcctctccttttaaagaatgctggttcccctttgcctcacagctaacacaagaactcctccaccgtctgaggaggtttaggagcagggaaggggaaggagtcagcttcatttgctaatcttctgttgccctgcaccctagcagctccttgcagcaggggacaaggatgacttaggtggatggataattaattgattctaaaatattgtgtgtcagtattgtaatactatgttaattgcaccatgcacggtatctcatttaatcccccaccccttgccattaccaaagagagagagagagagagagagagaaatactagaatttatcctcattttacagtagagaaaacagagggtcaagaagataatgtaaagtgcccaagaacacacagctgatcacaaaaatcaagcttgggggccattagcctaaccacagacccttactcttaacccatctgcttcaatccattttgctacaaatgtttacatttataagcagggcagaaaaacctcatccaggttattgaactaagaagaaagttatattaaggtttctaatttttttaatgtagttagaaaccaaacttaacaatgagcccaagtttaaagcagtctaattaacctggacaagctcaggcaagtttcattctgtggcccatagcatcatctgtgttgtaaagctaagtagcaaatgttgtttgggtcatgctgggggacaagccatcccaatttgctcaggactgaggggttttccaggatatcatgtaaggataattgggtacaaatataacctgctgctttctctcatttcaaatttatcatttatcatatcagcaactatgagttatgttttttattagatttcttgttactttttccccagaccacttcccatgaaattaatatactattatcactctccagatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagtt

SEQ ID NO: 2 - DNA, 2205 bp, Homo sapiens
  PDCD1 Enhancer
ggtgaggaaggggctgggtggccccacaaagcctccccggccacctgctcacatccctcgggcagcaagggctctggaagggccaccccagctggaatgtcattgagaagtctctgctggggcctctgccacccggggatgggcactggcctccactgcagagcctcttccttctacgtgaggctgcagcttctgcacagcacctggctctgacttgggtctccctgatttcctactaagagccttcacccccttccccgttgaggccagttcccccagaaagggctgtttgggggctacccatccccagcccctgacccttgggcatcctggcctggtcctgtctgcactgctctggcacaggggagtgtaactggtctgggtgggtggggggctgcccatggagaccccagccctgggaggagtgtggccccttggcaggctcagggtccagtctttgcccccttttcaggacaagctcggagctgggaccacgtggtatgggcattgctgccctgggcagtgggcagtggggcctccacattttccagcaagacagtggggactagagctcacagcaaagatgcttcagagacgagatgggccattgactcggatgtggacagacacggggcccccgaccctgggctcccaagacaaggacctcctgaaacatatgcctgccagggtcagggcttgggatacccgcatggcaacgtgggggtcgcggctcttccgccaggcggaggcaccaacacaggcgcttaagatccaggcccgagatgccatgcaacggggtgattttcccggctcacccacaggtcccatgccacagggttccccaaacatggcgccagccccacactgtcagacccagtgcactgtcactcagttccgtctcaggcctgggcacggccccccagcgaggtgacacagagaccaggccctggttgccacagctgcggtccctctgcttcctgggacaggcggcctccgtggcaggcggtggtgatgactcaaggagcaaccagctcagaggaggagggggctgctgccctcgtgtccctgcagccaggctggcccacggcgtgctggctggacaccagaggtgggtgggtctgtcatgtgaccaggaccaactcctagtgccaacctcactgggcaccctcccaggggacgagtgaggggtttgaagtgaccttgaggccacccagggtgtccctgttccctctgtgcccatggcctcccggctgacaagcgctcgcctccttcacctgcgtgcctgtcccccagcttcctggtggtgttcccagaggtggcaggggcgagggccagctacacaaggggctgctgaggtgagccccctctctgagaccgcccttgtctgccggccggccaggggaagctccctgcataggcgtgtgcggcgtgggcccggggaatcttccagccactccagagtggattttgaccaaggagggctgtggggtagtgtgactctcagggccagcaggcagccaggccagggcactcagagacctgcctgaatggaggaagatgggcttctggcatcagggccaagagggctcctgggaggcagcctgggacagggtgggctgcagcccttactgggcctaggctggggctgggtggactcggcacagagcaggggaaatgccctgccctctgggtttctgggaatgcagtggggacccaggggccccaccaccgcaggcagcccctcggggtctccatctcccaggccagggctgccatgcagctgtcgggacagacaggcaggtgaggaacagaagtcatcacgggtactgtgagcagggaccctgcatggctaggaagtgctaagggaccccccagctgtagggcgaggtgctggcgacaggacaatggccgctgtgtgtccacaccgcaatgtccctgggaccatctgtgcattgttcttgtaactggaaacttagctgctatttatttgcacacattggtggagggacctgctcctgacttgatctgtgctggcgctgacaggctcaacccttttcctgtctggcttgcaccagccctcagccactgggcctcaagccaggaccctgggctcctgttccgccccccccaacccccctattttggaatccaccccggggagcaggtccagctgggcccctcggcctcccctgcctccaccaactg

SEQ ID NO: 3 - DNA, 994 bp, Homo sapiens
  PDCD1 CTCF Binding Site
gatggggaggaggtgggcccgtggcccccacgccctaccccgtgggggtctccccagctcagggccccttcctcctctgtgtctctgctcactgctgtggcctctttccatatcccgcccgagctgcccctcctgaggctgccgggtgggggcaggcccttctcctcccccatcccccccatctccctgggggccgggcctccctgcctggggaaggtgggtggccccctctgggctcaggttcctgggctgcagtgaggggtgggctcaaccccactcccattctgtcggagcctctgggagcctcccggctgcccacagcctctgcccctgctgggggcaggtgcctggcctctgccttcccggcccatcccccttcgctggggcacaggtgaccctactgaatgacaactgtccatggctaatcggctccccctcaaagcttccaccttgtggatggcctcacaccatggccacagttccagatctttccaccgtgtgatgcctgcaacagcctgacgggggggctggggcggtggcaggggctggctgtgaggctgacctccccttccagccttgaccttcttccccggggccctgccctccagcccactcgtgccagggtggggtggttcagggggtccagtgcctgggcctggctggcggcccggcgtttgtgaaatggcttgcttatctccttgtattctgtgctgagcattttattacagcgaatggaaaacaggagaaatgaaactgctgatattagtgatgagatgcgtcaggctcatcagcttaaaataaccgaagcgaggctagaaaccgcctgacagctggcgcggctgcctggctccgagagacactcggcccggctctgaagggaaaacattaaagcaccgaaacagtggaaaaagagcatcaaagatgatgtctgcgaggcgcggccacggcgaggaagctctcgtttatgaacaaagggccactcccgggtctcaga

SEQ ID NO: 4 - DNA, 25 bp, Artificial Sequence
  Description of Artificial Sequence: Synthetic oligonucleotide
  Forward Primer ACTB
cccttaaaaattacaaaaaccacaa

SEQ ID NO: 5 - DNA, 24 bp, Artificial Sequence
  Description of Artificial Sequence: Synthetic oligonucleotide
  Reverse Primer ACTB
ggaggaggtttagtaagttttttg

SEQ ID NO: 6 - DNA, 30 bp, Artificial Sequence
  Description of Artificial Sequence: Synthetic oligonucleotide
  Atto 647N/BHQ-2 labeled probe ACTB
accaccacccaacacacaataacaaacaca

SEQ ID NO: 7 - DNA, 106 bp, Artificial Sequence
  Description of Artificial Sequence: Synthetic polynucleotide
  Sequence ACTB Amplicaon
ggaggaggtttagtaagttttttggattgtgaatttgtgtttgttattgtgtgttgggtggtggttattttttttattaggttgtggtttttgtaatttttaaggg

SEQ ID NO: 8 - DNA, 51 bp, Homo sapiens
  Sequence of Binding Site of Probe cg15837913 of the Infinium HumanMethylation450 BeadChip
tcgggatgggaagttcttttaatgacaaagcaaatgaagtttcattatgtc

SEQ ID NO: 9 - DNA, 50 bp, Homo sapiens
  Sequence of Binding Site of Probe cg02823866 of the Infinium HumanMethylation450 BeadChip
agctttattcctaggacaccaacactagatacctaaactgaaagcttccg

SEQ ID NO: 10 - DNA, 50 bp, Homo sapiens
  Sequence of Binding Site of Probe cg14305799 of the Infinium HumanMethylation450 BeadChip
cggccccagttctgcgcagcttcccgaggctccgcaccagccgcgcttct

SEQ ID NO: 11 - DNA, 50 bp, Homo sapiens
  Sequence of Binding Site of Probe cg13474877 of the Infinium HumanMethylation450 BeadChip
cgatggtctagggggcagtagagccaattacctgttggggttaataagaa

SEQ ID NO: 12 - DNA, 50 bp, Homo sapiens
  Sequence of Binding Site of Probe cg19724470 of the Infinium HumanMethylation450 BeadChip
cgggtccaagtccaccgccagctgcttgctagtaacatgacttgtgtaag

SEQ ID NO: 13 - DNA, 28 bp, Artificial Sequence
  Description of Artificial Sequence: Synthetic oligonucleotide
  Forward Primer CD274
atataaaataaataatcattcttatacg

SEQ ID NO: 14 - DNA, 27 bp, Artificial Sequence
  Description of Artificial Sequence: Synthetic oligonucleotide
  Reverse Primer CD274
cgtttagggattttggatttgtttagc

SEQ ID NO: 15 - DNA, 24 bp, Artificial Sequence
  Description of Artificial Sequence: Synthetic oligonucleotide
  FAM/BHQ-1 labeled probe CD274
cacgaatccaaatccaccgccaac

SEQ ID NO: 16 - DNA, 191 bp, Artificial Sequence
  Description of Artificial Sequence: Synthetic polynucleotide
  Sequence CD274 Amplicaon
cgtttagggattttggatttgtttagcgtaggaagagatttatttagatgttgtagttgggataatttatataagttatgttattagtaagtagttggcggtggatttggattcgtgtttagatttttagtttagtattagagttatattttgaatatatagtcgtataagaatgattatttattttatat

SEQ ID NO: 17 - DNA, 9028 bp, Homo sapiens
  Coding Sequence of the PDCD1 Gene
tccttagcatgctctcatatttaattataattataatataatagaaccacagggaagggggatcccttgtcccagccactcaggtgcctgctggccgcctggatgctggtggccctgccccaggagtgggggtgcagtgtgtggatgtgaggagtggataggccacggcgggggtactaggccccgggggaacgcctgtaccttcccacccaggccctggtgggagcccggccaacccctttaaataatttcaggaatgggttccaaggagagctcccagggtgggcacatggggggccctaggtgcctgcacttctgccctcccaacacccaggtggccacagctgggaggggcctgagtcaaccccagccctgccctcctgaccttgggaccgtaggatgtccctctcccgagtggtgtgaggggctggggtggaatgcggcggcaggaggccagagtgctggctgggcctgaaaggcctccagctctgcctgcccgcttactgcctcagcttccctgccccacaaagggcctgaggtgctgcctgggcatgtgtaaaggtggaggggtttcctgccctgcccaccacagccaggagctcttctgaccttccctgaaacttctctaggcctgcagggagcagataactcctggggagtccccagccccatgtacctcccactcctgtgcccagtcttgggccctgcgtccagggcgtttcgggatgccactgccaggggcaccttggctgctccaaggccatctccaaccagcccccaagttcaggcaggaggctccggggcgtcaggcagggccacggcgccttcagccccgggccgcaggcagcagcagcagcagcagcagcagcagcagagattcagggagctggacgcaggcagctctgtgctggcaggacctgaagcagtgactgcatctggccctccctgtaggggacggtgacacctgctgcctgggctcactgtgggcattgagacatgagtcctgtggtggggctgtgcctggtgcaggtgcaggctggagccccggtcgcccccaggcagctcagcccctggacggcctgcaatggcctgcaccctgcctgcttctcctgaggaaatgcgctgacccgggctcatggtggagggtctgcagaacactggtggccaaggaagccggtcagaggggccaagagcagtgtccatcctcaggcctcagtggctgggcactccgagggccgtcagctgagcccctgcgggcgggggatgaggtgcccattccgctaggaaagacaatggtggcatactccgtctgctcagggacacagggcacggggggctccggggtcttctctcgccactggaaatccagctccccatagtccacagagaacacaggcacggctgaggggtcctccttctttgaggagaaagggagagggagtcagccccacggcccaccgcaggaaggaggcccgcggctccacagcctggctgcagtaccggcaccgaacctgggccccccactatgagctgcttaccctgagctgtcccaccactgccctctgtgtgatctggggacaccacccctcctctctggctcaatgtccccctctgaaatgtccctggcattcttgcagatttaggattccaaaatgtgacttttcaagctctcctgtctccaatgtaagataagaaatgaccaagcccaccccacgccctcgcaggtgggcacacgcatgggccgggcacacctggagaccgcaggcaggcacatatgtgggccgggcacccccagagaccgcaggcgggcacacgcgtgggccaggcacccctggagaccgcaggcaggcacacacatgggccgggcacccccggagaccgcaggtgggctggggccccagatcatggctttagggattgaggttgctgcctgggggctggggaggtggggtcctggctataatagaatgtgagtcctgcaggccgtgtggtcccagcctgtccttccacctctgcccacccaggaaggaaggcacagtggatcatgcaggaaaagagtgagactcaccaggggctggccggtgcgcctggctcctattgtccctgcagagaaacacacttggggtcaccaggccgaccctgagccgtgctcctaggtggggggtcttagtccaggggccttcatcagggacttagcctggcggggagatggggggaggtggggtggggtgagggaagggtggaggaaggggaggcgggagtgagggccgccagcagggttagggcagggcaggccgaggggctgggatgacgttacctcgtgcggcccgggagcagatgacggccaggacccagactagcagcaccaggctgcccagcaggccgcccacgacaccaaccaccagggtttggaactggccggctggcctgggtgaggggctggggtgggctgtgggcacttctgcccttctctctggaagggcacaaaggtcaggggttaggacggggtcagggtggagggtcagggtcaggggtgagggcagactagaggggctggggtgcttccagagctagaggacagagatgccggtcaccattccccaggtgcaggacagagccctggactggagctggggggtccctgccctacgaccctggagctcctgatcctgtgcaggaggggacacccaccccaggaccggctcagctcacccctgccccggggcctccgaggccgcacctgtcaccctgagctctgcccgcaggctctctttgatctgcgccttgggggccagggagatggccccacagaggtaggtgccgctgtcattgcgccgggccctgaccacgctcatgtggaagtcacgcccgttgggcagttgtgtgacacggaagcggcagtcctggccgggctggctgcggtcctcggggaaggcggccagcttgtccgtctggttgctggggctcatgcggtaccagtttagcacgaagctctccgatgtgttggagaagctgcaggtgaaggtggcgttgtccccttcggtcaccacgagcagggctggggagaaggtgggggggttccagggcctgtctggggagtctgagagatggagagaggtgaggaaggggctgggtggccccacaaagcctccccggccacctgctcacatccctcgggcagcaagggctctggaagggccaccccagctggaatgtcattgagaagtctctgctggggcctctgccacccggggatgggcactggcctccactgcagagcctcttccttctacgtgaggctgcagcttctgcacagcacctggctctgacttgggtctccctgatttcctactaagagccttcacccccttccccgttgaggccagttcccccagaaagggctgtttgggggctacccatccccagcccctgacccttgggcatcctggcctggtcctgtctgcactgctctggcacaggggagtgtaactggtctgggtgggtggggggctgcccatggagaccccagccctgggaggagtgtggccccttggcaggctcagggtccagtctttgcccccttttcaggacaagctcggagctgggaccacgtggtatgggcattgctgccctgggcagtgggcagtggggcctccacattttccagcaagacagtggggactagagctcacagcaaagatgcttcagagacgagatgggccattgactcggatgtggacagacacggggcccccgaccctgggctcccaagacaaggacctcctgaaacatatgcctgccagggtcagggcttgggatacccgcatggcaacgtgggggtcgcggctcttccgccaggcggaggcaccaacacaggcgcttaagatccaggcccgagatgccatgcaacggggtgattttcccggctcacccacaggtcccatgccacagggttccccaaacatggcgccagccccacactgtcagacccagtgcactgtcactcagttccgtctcaggcctgggcacggccccccagcgaggtgacacagagaccaggccctggttgccacagctgcggtccctctgcttcctgggacaggcggcctccgtggcaggcggtggtgatgactcaaggagcaaccagctcagaggaggagggggctgctgccctcgtgtccctgcagccaggctggcccacggcgtgctggctggacaccagaggtgggtgggtctgtcatgtgaccaggaccaactcctagtgccaacctcactgggcaccctcccaggggacgagtgaggggtttgaagtgaccttgaggccacccagggtgtccctgttccctctgtgcccatggcctcccggctgacaagcgctcgcctccttcacctgcgtgcctgtcccccagcttcctggtggtgttcccagaggtggcaggggcgagggccagctacacaaggggctgctgaggtgagccccctctctgagaccgcccttgtctgccggccggccaggggaagctccctgcataggcgtgtgcggcgtgggcccggggaatcttccagccactccagagtggattttgaccaaggagggctgtggggtagtgtgactctcagggccagcaggcagccaggccagggcactcagagacctgcctgaatggaggaagatgggcttctggcatcagggccaagagggctcctgggaggcagcctgggacagggtgggctgcagcccttactgggcctaggctggggctgggtggactcggcacagagcaggggaaatgccctgccctctgggtttctgggaatgcagtggggacccaggggccccaccaccgcaggcagcccctcggggtctccatctcccaggccagggctgccatgcagctgtcgggacagacaggcaggtgaggaacagaagtcatcacgggtactgtgagcagggaccctgcatggctaggaagtgctaagggaccccccagctgtagggcgaggtgctggcgacaggacaatggccgctgtgtgtccacaccgcaatgtccctgggaccatctgtgcattgttcttgtaactggaaacttagctgctatttatttgcacacattggtggagggacctgctcctgacttgatctgtgctggcgctgacaggctcaacccttttcctgtctggcttgcaccagccctcagccactgggcctcaagccaggaccctgggctcctgttccgccccccccaacccccctattttggaatccaccccggggagcaggtccagctgggcccctcggcctcccctgcctccaccaactggctgggtggggtgggggctagacctcggtgtctgcagttcaagcagccccctctcccacctcccccagccagtctcagagactggctcccacccagtgtgggggtgctgggtggcgacccccacgcagggcctgcctcaccccagtcctcaggccacctcctccaggaaggcttcctggcctcccttggctggtagtgtctactaggaaggtgaatattcagaagtgaccactggctggtcctggatcaagttagatttggggtgtttctatgggattccattgtttccccaggtgctccctctcggatccacgtaggatcgtgggttgatgagagagggctgtgccctatgcagggtcaggagggagacagagcccatcccggggctgtggaacaggcctgtgaggtggcggtgggggtgctcccgcagagagaccgcattacaggacattgctttccagaagcgcacagaagaaggctgcctgccccgggcggaggaacctgctggcccagaccagacccggcatctctgaccgtggtcccattagggacaaggaaaccgtcccacgggctgtgctgggatgaggacagcgagcttgtccctagaggacctggcaggggtgaggagtgaggtcttccaactcctcacagtcgtgtgtgtgtgtggaggtgggaagggctgtgggccgaaccgtgtccccacagattcctatgtggaagtcctaaccccatgacctcagaaggcggccttattaggaatagggtgacggcagctgggactaggtaagatgagggcacagggctgggtggccattgaccagcaggcctggcttcctgtacagagtcacccgtgcagagatgaaggcagagcctgggggatgcttctgaacccaggaacacagagggtggccacaaaaccccccagccaggagaagctgagcagagccctctcggagcacagggagccgaccctgtggcccctcggtcctgcatgtccagccccccacggcgggaggacaggctctgtttttaagccacagccgggagaggctgagcagagcccctcagagcacaggggagccgaccctgcggagctccatcctgcacgtccagccctcagtcggcgagagggcaggctctgtttaaaagccactcggtcggcggagctttgtcatggcagctccagccgcccagtccccaaagcaaatgtgtcaatattcttagttattgattctaggtgagggatattcattgtttttaaacgtttttgtatatttttcaaaatagtccgtttaaaatctgacttcaaaagtttgactttaaaaatcagactttaaaaatatgtgtcatggaggccagatgcagtggcttatgcctgtaatcccagtacttggggaggctgaggtgggaggaccatttgagcccagcctggggaacatagcgagaccctgtctctaaaaaaaatggaagaaattagcctggcagggtggcacgtgcctatagtcccagctactctggaggcagaggtgggagaattgcttgagccccggaggtcgagtgagccgagatcacaccactgcactccagcctgggtgacagagcaagaccctgtcactaaaagaaacaaacaaaaaagtgtcaggggctgggctgggtagttttcacagatgacccgatttaatcctcaggacgcagccttgccaggaggcgtcctcacccatgacccaaagcacacggagaagtcagtaaggggccaagtcctgtcgaaggcccagagctcagcagtggcagcgctgactggagctcacagtggtcccacgccaaagcagaggctcttatttatgctcctgccctcggacggggccaataagcagccgggttggggatatctcataaaacacaagggaagcacacacctgaggtgggagtggtggccccgggaatgaccgaatggcgaacgcagtgaatagatcaggagggaaaagaggcatcctggaatgaagaccactgcggccggggtggccacatctgggtcaggacccacaggaccccagtcatgcccactgcgccttgctgagtgccctgtgctgttaccagtggggaaaccgaggcatgccacctgtgagagtcttgtccggcacaagcgcgggcacctgaggcacgagtgtcaggctgcggacaccttgctcttatctttcccgcctgggtcggggagggtggcgtcccgagggcgtgcctgaagagccgggacacggggggagaggctcggctcccctcctgcctcgctcagctccccctcccctgtgacgagcgcccctctgccctctggttcccccgcagtcgtctccctgggatgccttttggccctttgctctttgccttttgcccagaatctccagttctgagtcctgagtgacccacgggccaaccttaagaggtggcgctgaggcaggaaggcacggccctgacaaggatgctgcctcaggtgccggggagcaggccccgggagaggggccgaggtggggaacccccagtcgcctgccacagtgaaggggcaccaggacccccggggcaggagcctcgagggggtgtcagggcggccccaggggtgcccctcatcttgtcctcccagtggtgtcacaccccggtacccagcagggcccagagggactgtcttaggcttggcctgggtgaaaccaccctccccaggccttggcatccccaggtgcaggctggctgggcacagagggccagccgggcacagagggtccaggagcgggctgtggtcacagtgtacacagagggcccagggtcacgggcagcccaggaagaggctccctctctcctcgatccgggagagtgaggccaaggcctcccccacggatggtctgaacagggctcggggagagccctggaatctgggcagagacccaggcgggcacaatccccacccaggagggatcctggagacagaagaactgtcctcactcgaacaggtacactttggatataatgagaaaaatatcaccagctcatctaaactttgacgtcgtaaagccaaggttagtcccacatggggctcatcccatccttaggaaaactcgagtgaggaccaaggatgcctgggcaaggcagagccgccacgcagactccccacggccaaggtttggggttctggccagcctgacccgtcattctacagaaacacgcagccccaaggaccggctgagaggggacagaggtcctgcctgcccaggagcaaagaggggacttgggccaggggaggagttggggcccagagaggaacccaggagttcgagctgcccaaagccacacagctcagggtaaggggcagagctgggggccaaggctgggcctgccacagcaccccccgacctgccagggactgagagtgaaaggtccctccagacccctcgctccgggacccctgggctgccagggccaggcccgcctcagcaccccccgacctgccagggactgagggtggaaggtccctccagacccctggctctgggacacctgaccgccgaccccacctacctaagaaccatcctggccgccagcccagttgtagcaccgcccagacgactggccagggcgcctgtgggatctgcatgcctggagcagccccaccagagtgccgccttctccactgctcaggcggaggtgagcggaagggaaactgt

SEQ ID NO: 18 - DNA, 3951 bp, Homo sapiens
  1st Region of open chromatin within the PDCD1 gene
tcattttccatgggacctatcgggttttgcggatggaaacccacatcatgtgcagagcccccgggcagcgttccctgccaggcctgatctgccggatctcaccgggagttcccagagctgcgaggtctctgtgcctgtccctgacacaggcatggggtccaggactgggctccaggatggcaagcagagaatgagccccggggtgtcagtgggtgtttggctgcggtgcccgagggcctggcagggctcctttccctgcaccgtccctgctgctagctgccaaggaccgcagcagggtgatagggctccagcagacgtgaccccgcctcccccgctgcccccaccctgtgtacttagggagggacccgcagatgctgtgtccctcatagcccagggcagccctcccaccccgctgtggacgccctggcaccaggtaccacccctgcccggagggactggtaggcatggggacacgggggctatggagcaggcacagtcactcagggacacccatgcctggccaggaagcctggggccagggggccgtgggacccccctaaaaggcctgggcttggggaagatggtgtccccagccccgtgatgttggaggaatttttcaccggagggctctacatgtgagtggggcaaacagggcgaggagggcctgtgtgtttctgggacagcgaggggaaggcctgactcaggccaggatccaggggagccaccagcaccctccacacacagcctcagcctggctgccgccttgtccctccctggaggcctccctccctcctgcccactgcccccacagccaccagacaggacagaactccttagcatgctctcatatttaattataattataatataatagaaccacagggaagggggatcccttgtcccagccactcaggtgcctgctggccgcctggatgctggtggccctgccccaggagtgggggtgcagtgtgtggatgtgaggagtggataggccacggcgggggtactaggccccgggggaacgcctgtaccttcccacccaggccctggtgggagcccggccaacccctttaaataatttcaggaatgggttccaaggagagctcccagggtgggcacatggggggccctaggtgcctgcacttctgccctcccaacacccaggtggccacagctgggaggggcctgagtcaaccccagccctgccctcctgaccttgggaccgtaggatgtccctctcccgagtggtgtgaggggctggggtggaatgcggcggcaggaggccagagtgctggctgggcctgaaaggcctccagctctgcctgcccgcttactgcctcagcttccctgccccacaaagggcctgaggtgctgcctgggcatgtgtaaaggtggaggggtttcctgccctgcccaccacagccaggagctcttctgaccttccctgaaacttctctaggcctgcagggagcagataactcctggggagtccccagccccatgtacctcccactcctgtgcccagtcttgggccctgcgtccagggcgtttcgggatgccactgccaggggcaccttggctgctccaaggccatctccaaccagcccccaagttcaggcaggaggctccggggcgtcaggcagggccacggcgccttcagccccgggccgcaggcagcagcagcagcagcagcagcagcagcagagattcagggagctggacgcaggcagctctgtgctggcaggacctgaagcagtgactgcatctggccctccctgtaggggacggtgacacctgctgcctgggctcactgtgggcattgagacatgagtcctgtggtggggctgtgcctggtgcaggtgcaggctggagccccggtcgcccccaggcagctcagcccctggacggcctgcaatggcctgcaccctgcctgcttctcctgaggaaatgcgctgacccgggctcatggtggagggtctgcagaacactggtggccaaggaagccggtcagaggggccaagagcagtgtccatcctcaggcctcagtggctgggcactccgagggccgtcagctgagcccctgcgggcgggggatgaggtgcccattccgctaggaaagacaatggtggcatactccgtctgctcagggacacagggcacggggggctccggggtcttctctcgccactggaaatccagctccccatagtccacagagaacacaggcacggctgaggggtcctccttctttgaggagaaagggagagggagtcagccccacggcccaccgcaggaaggaggcccgcggctccacagcctggctgcagtaccggcaccgaacctgggccccccactatgagctgcttaccctgagctgtcccaccactgccctctgtgtgatctggggacaccacccctcctctctggctcaatgtccccctctgaaatgtccctggcattcttgcagatttaggattccaaaatgtgacttttcaagctctcctgtctccaatgtaagataagaaatgaccaagcccaccccacgccctcgcaggtgggcacacgcatgggccgggcacacctggagaccgcaggcaggcacatatgtgggccgggcacccccagagaccgcaggcgggcacacgcgtgggccaggcacccctggagaccgcaggcaggcacacacatgggccgggcacccccggagaccgcaggtgggctggggccccagatcatggctttagggattgaggttgctgcctgggggctggggaggtggggtcctggctataatagaatgtgagtcctgcaggccgtgtggtcccagcctgtccttccacctctgcccacccaggaaggaaggcacagtggatcatgcaggaaaagagtgagactcaccaggggctggccggtgcgcctggctcctattgtccctgcagagaaacacacttggggtcaccaggccgaccctgagccgtgctcctaggtggggggtcttagtccaggggccttcatcagggacttagcctggcggggagatggggggaggtggggtggggtgagggaagggtggaggaaggggaggcgggagtgagggccgccagcagggttagggcagggcaggccgaggggctgggatgacgttacctcgtgcggcccgggagcagatgacggccaggacccagactagcagcaccaggctgcccagcaggccgcccacgacaccaaccaccagggtttggaactggccggctggcctgggtgaggggctggggtgggctgtgggcacttctgcccttctctctggaagggcacaaaggtcaggggttaggacggggtcagggtggagggtcagggtcaggggtgagggcagactagaggggctggggtgcttccagagctagaggacagagatgccggtcaccattccccaggtgcaggacagagccctggactggagctggggggtccctgccctacgaccctggagctcctgatcctgtgcaggaggggacacccaccccaggaccggctcagctcacccctgccccggggcctccgaggccgcacctgtcaccctgagctctgcccgcaggctctctttgatctgcgccttgggggccagggagatggccccacagaggtaggtgccgctgtcattgcgccgggccctgaccacgctcatgtggaagtcacgcccgttgggcagttgtgtgacacggaagcggcagtcctggccgggctggctgcggtcctcggggaaggcggccagcttgtccgtctggttgctggggctcatgcggtaccagtttagcacgaagctctccgatgtgttggagaagctgcaggtgaaggtggcgttgtccccttcggtcaccacgagcagggctggggagaaggtgggggggttccagggcctgtctggggagtctgagagatggagagaggtga

SEQ ID NO: 19 - DNA, 774 bp, Homo sapiens
  2st Region of open chromatin within the PDCD1 gene
cacaatcctcaacacacacacaattcccaatacacacacaatccccaacacacccaatccccagcacacacacagaatctcccccacacacaatcctcaacacacacacaatccccaacacacccaatccccagcacacacacacaatctcccccacacacaatccccaacacacacacaacccccaacacatacacaatccccaacacaatccccaacacgcaatctacaacacccacacaccacaatccccaacacacatacaaaatctgcaatatacacacaatccccaacacacgatttccaacacacacaactcccaaacatacatgctccccagcacacacactttcctcccacacacatcctaagcccgtgccttccacccagtaggcttccactgtcttctgtcacgaggaggaaaggcaggcggagtccggggagcagggtagatggggctaaggggcccttggctggccggccctgcgcacccctcccccatctccttttctcagccttccttcccagggaacctggacacccaggcccttcccccaccgcctgctccttcctcacagagggtcataccccatccaaatcactggccctgggatggcagcagccagattcaatccagggcattcagttaaaagataatttacaacaagcaaagttgtatgtggtttttgtctgtttattttcttttagagacagggtcttgctctgcacccaggctggagtgcagtggtgtgatcttggctcactgcagcctcg

SEQ ID NO: 20 - DNA, 50 bp, Homo sapiens
  Sequence of Binding Site of Probe cg00795812 of the Infinium HumanMethylation450 BeadChip
cgtcaggctcatcagcttaaaataaccgaagcgaggctagaaaccgcctg

SEQ ID NO: 21 - DNA, 12 bp, Artificial Sequence
  Description of Artificial Sequence: Synthetic oligonucleotide
atcgatcgatcg

SEQ ID NO: 22 - DNA, 50 bp, Homo sapiens
  Sequence of Binding Site of Probe cg03889044 of the Infinium HumanMethylation450 BeadChip
cggctctgaagggaaaacattaaagcaccgaaacagtggaaaaagagcat

SEQ ID NO: 23 - DNA, 50 bp, Homo sapiens
  Sequence of Binding Site of Probe cg17322655 of the Infinium HumanMethylation450 BeadChip
cgaaacagtggaaaaagagcatcaaagatgatgtctgcgaggcgcggcca

SEQ ID NO: 24 - DNA, 50 bp, Homo sapiens
  Sequence of Binding Site of Probe cg20805133 of the Infinium HumanMethylation450 BeadChip
agcatcaaagatgatgtctgcgaggcgcggccacggcgaggaagctctcg

SEQ ID NO: 25 - DNA, 23 bp, Artificial Sequence
  Description of Artificial Sequence: Synthetic oligonucleotide
  Forward Primer PDCD1
tcgaagcgaggttagaaatcgtt

SEQ ID NO: 26 - DNA, 22 bp, Artificial Sequence
  Description of Artificial Sequence: Synthetic oligonucleotide
  Reverse Primer PDCD1
ccttcaaaaccgaaccgaatat

SEQ ID NO: 27 - DNA, 25 bp, Artificial Sequence
  Description of Artificial Sequence: Synthetic oligonucleotide
  FAM/BHQ-1 labeled probe PDCD1
ttggcgcggttgtttggtttcgaga

SEQ ID NO: 28 - DNA, 3644 bp, Homo sapiens
  cDNA CD274-001
gcgtcccgcgcggccccagttctgcgcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaa

SEQ ID NO: 29 - DNA, 4518 bp, Homo sapiens
  1st Promoter of PDCD1
tcctcacccatgacccaaagcacacggagaagtcagtaaggggccaagtcctgtcgaaggcccagagctcagcagtggcagcgctgactggagctcacagtggtcccacgccaaagcagaggctcttatttatgctcctgccctcggacggggccaataagcagccgggttggggatatctcataaaacacaagggaagcacacacctgaggtgggagtggtggccccgggaatgaccgaatggcgaacgcagtgaatagatcaggagggaaaagaggcatcctggaatgaagaccactgcggccggggtggccacatctgggtcaggacccacaggaccccagtcatgcccactgcgccttgctgagtgccctgtgctgttaccagtggggaaaccgaggcatgccacctgtgagagtcttgtccggcacaagcgcgggcacctgaggcacgagtgtcaggctgcggacaccttgctcttatctttcccgcctgggtcggggagggtggcgtcccgagggcgtgcctgaagagccgggacacggggggagaggctcggctcccctcctgcctcgctcagctccccctcccctgtgacgagcgcccctctgccctctggttcccccgcagtcgtctccctgggatgccttttggccctttgctctttgccttttgcccagaatctccagttctgagtcctgagtgacccacgggccaaccttaagaggtggcgctgaggcaggaaggcacggccctgacaaggatgctgcctcaggtgccggggagcaggccccgggagaggggccgaggtggggaacccccagtcgcctgccacagtgaaggggcaccaggacccccggggcaggagcctcgagggggtgtcagggcggccccaggggtgcccctcatcttgtcctcccagtggtgtcacaccccggtacccagcagggcccagagggactgtcttaggcttggcctgggtgaaaccaccctccccaggccttggcatccccaggtgcaggctggctgggcacagagggccagccgggcacagagggtccaggagcgggctgtggtcacagtgtacacagagggcccagggtcacgggcagcccaggaagaggctccctctctcctcgatccgggagagtgaggccaaggcctcccccacggatggtctgaacagggctcggggagagccctggaatctgggcagagacccaggcgggcacaatccccacccaggagggatcctggagacagaagaactgtcctcactcgaacaggtacactttggatataatgagaaaaatatcaccagctcatctaaactttgacgtcgtaaagccaaggttagtcccacatggggctcatcccatccttaggaaaactcgagtgaggaccaaggatgcctgggcaaggcagagccgccacgcagactccccacggccaaggtttggggttctggccagcctgacccgtcattctacagaaacacgcagccccaaggaccggctgagaggggacagaggtcctgcctgcccaggagcaaagaggggacttgggccaggggaggagttggggcccagagaggaacccaggagttcgagctgcccaaagccacacagctcagggtaaggggcagagctgggggccaaggctgggcctgccacagcaccccccgacctgccagggactgagagtgaaaggtccctccagacccctcgctccgggacccctgggctgccagggccaggcccgcctcagcaccccccgacctgccagggactgagggtggaaggtccctccagacccctggctctgggacacctgaccgccgaccccacctacctaagaaccatcctggccgccagcccagttgtagcaccgcccagacgactggccagggcgcctgtgggatctgcatgcctggagcagccccaccagagtgccgccttctccactgctcaggcggaggtgagcggaagggaaactgtcccaggtcaggttgaagggagggtgcccgccccttgctcccgccccctcttcctccacatccacgtgggcgagagtgacagaggcagtgctgggggaggaggggtgaggagggggtaggactggggagagggtgggggagggagagagagacagagacagggagacagaggagatggggaggaggtgggcccgtggcccccacgccctaccccgtgggggtctccccagctcagggccccttcctcctctgtgtctctgctcactgctgtggcctctttccatatcccgcccgagctgcccctcctgaggctgccgggtgggggcaggcccttctcctcccccatcccccccatctccctgggggccgggcctccctgcctggggaaggtgggtggccccctctgggctcaggttcctgggctgcagtgaggggtgggctcaaccccactcccattctgtcggagcctctgggagcctcccggctgcccacagcctctgcccctgctgggggcaggtgcctggcctctgccttcccggcccatcccccttcgctggggcacaggtgaccctactgaatgacaactgtccatggctaatcggctccccctcaaagcttccaccttgtggatggcctcacaccatggccacagttccagatctttccaccgtgtgatgcctgcaacagcctgacgggggggctggggcggtggcaggggctggctgtgaggctgacctccccttccagccttgaccttcttccccggggccctgccctccagcccactcgtgccagggtggggtggttcagggggtccagtgcctgggcctggctggcggcccggcgtttgtgaaatggcttgcttatctccttgtattctgtgctgagcattttattacagcgaatggaaaacaggagaaatgaaactgctgatattagtgatgagatgcgtcaggctcatcagcttaaaataaccgaagcgaggctagaaaccgcctgacagctggcgcggctgcctggctccgagagacactcggcccggctctgaagggaaaacattaaagcaccgaaacagtggaaaaagagcatcaaagatgatgtctgcgaggcgcggccacggcgaggaagctctcgtttatgaacaaagggccactcccgggtctcagagatgtgaggctgtgtgggtggcttggtggggaggtggggggggcccagctggccaggtgggcttggcggggggcccccagggagcctggcagcacccactgtgctgccagacagctaaggtggcccgcagcaactgtctcctggcacacccacccttgtgcctcaggggctggggctctggggctggagaactgttggttggtaggtgcctccatagccctgtgcctcgcccaggcagtggataagtggctaagctgcccctgctggctgtacttgtcctgaaggcagattctggacagaacctccctctgcccccagccctgtagagccttgttccaacctctgttgaatgctgtctctgttccagggcagcagtgggccttcctcaaggctctgagctttgtgggacgaagctgtcctctgaggactgggaatgccactgtgtgggctggaggggaggctgggcccaggaggtgggctctgagatgggagatgctatcagacccctggaaggtctcctcaccaccaaggccctgcccccaaaattccacctgccagggcttggacacatgtcctggagtagggggcgggcacagggagaaacccagcttccatcctaccccttccttccttctccttctcccacccctctcctctctccctgcagttcttccctgtcacccactctccttccctcctcctctcagtcccactgaaggcccctgggccatgggagaggagacctggtggggtgggcccagcgtggagccaggggactgcggccactgaggccagggctgcctgatggtctctccacattgctactcgctggagcacctgcaaagagacacatggacccagggagggtctgcagggctgcgaggggtctgagcctggagagcacagggcctgcagggatgcaggcattgggcattgggcctggactagtaggctgaacctacagggtcctgggaccccaccccgaagcagataggcggtcccagggctcaggtgtggggtggggactcatggagcctgcaccccaatatcacactccagaccacttattgacaccctcccccaaacacatacggtgtccccaacacacgatttccaacacaccacaccccaacacacacagtccccaacacacacacagtccccaacacacacacaatctccaacacacacaatccccccacacacaatcctcaacacacacacaaaattcccaacacacacaatccccaaaacatacacagtccccaacacacacacaaaattcccaacacatacaatctccaacacacacaatccccctgcacacaatcctcaacacacacacacaattccca

SEQ ID NO: 30 - DNA, 2302 bp, Homo sapiens
  2nd Promoter of PDCD1
actctgctcagtctctctgaatgataacagtttggaaaaccacaggacaacgtcacaaccaggttaatgactttgatgtgacacctcgatcccatcctgagtccccgtttctggctaatgtgtgcctatcaaaggctgcacaatgtgggcacaagcgaaggctcctgcatcccctgacagcgaagctgcagaacgtccccatcaccacggggtcctccgggtgcccttggcaatacacccacctccctgctggtggccacgagcctgccctccacccccatcactgtttcattccagcgacagccgtgggaaggtgcagtacgcatccttccgggattccctggagatgcctccagcgcgtgtgtttcagcagcccgttcctctctgtgccgagccatccaggctgtggtgtggatgtacgtaccacaccacaatttagtcagccattcttcagtttaagtgagtctgggtggactccagttcttggtgactatgactaaaggccccggaagccctctgtgggccagagcgcccaggaggccaggggatctaggactgctttccgagactggggccttgctctcaggggcctggagaaggttcccctcgctgggggccctcccatgctcctggactgagaagagaaaccctacagtttccaaggagcctgcacgtcatgacgcatggcgcccggcgcacggcagtggtgagatgggccccgtgtgctggaacatgagccagcagcgatggaaagtggcgaggggaggggaatccccgtgctcgctcgggccagtgggaagtttccatccgcgcagggacggtccggggaagcactggaaacagcaggaccatcccgaaactgcttctgcagtgggaggcgccgggcgcccggctggccgggtggaaaccacgctgcagccgccgggccaagggcaccgcggtggggaggcagcgcctgattcacagcaatttctgaggttggaacaggaaatggttaatagtgtttgcaaataaaaactctctgttctatcctgttttcgaaacatttcccagaagttaaaaaataacacccaatttatctgcccaatttaagaataaactttttaaaaattgaatgagatatttccacaatttattatacacacaaaaaaatcgttgggctgtttgttaagggggggtggcaggtgatttctagccaccccccccgctgttttctaaactttctagaatgtggttagtagtttagatgtcaatttatgttctaaatctcccagtgtgtacatgtatatgtgtgtgtgtaggtgtgtgtgtttatgtgtactgtatgtggtatgtgtattgtgtgtgttggtgtgtatctctgttcatgtatattgtgtgttgtatgtagtatgtgttatgtgtgttgtgtgtagtgtacgtggtgtttggtgtgtgtagtgtgtgtggtgtgtgtgtagtgtgtgtggttgtagtgtgtgttgtgtgtgtagcatgtgtgctgtgtgtactgtgtgtgtttgtgtgtgatatgtgtgtgctgtgtgtggtgtgtggtgtgtgtgtagtgtatgtggtgtatgttgtgtgtgagctgtgtgtgatgtgtgtagagtgtggtgtgtgtgtagtgtgttgtgtgtgtggtttgtgtgatgtgttgtgtgtagtgtgtgtggtatgtgtgctgtgttgtgtgtgagctgtgtgtgatgtgcataatgtgtggtgtgtgtggtgtgtggtgtagtgtgtggtgtgtgtggtgtgtgtagtgtgcatttgtgtggtgtgtgtggtgtgtgtagtgtgcatttgtgtgtggtgtgtgtggtgtgtgtagtgtgtgtggtgtgtggtgtaatgtgtttggtgtgtgtagtgtgcattgtgtggtgtgtgtagtgtgtacgtggtgtgtggtgggtgtagtgtgtgtgtggtgtgtgtagtatgtgttgtgtgtgttgtgtggtgtagtgtgtggtgtgtgtggtgtgttgtgtgtgtggtgggtgtagtgtgtgtggtgtgtagtgtagtgtgtgtggtgtgtgtgtggcatgtgtggtgtttggtgtgtgtggtgtgtgtagtgtttttatgtagtgtgtggtgtgtgtcgtgtgtgtggtgtgtgtcgtgtgtgtagtgtgtgtgtggtgtttggttgtgtagtgtgtgtggtgtgtgtactgtgtgtggcgtgtttggcgtgtgtgtttgtgtgtggtatgtgtagtgtgtgtggtgtgtgcggtaatgtgtggtgtttctgtggtgtgtgtagtgtgtgtttgtg

SEQ ID NO: 31 - DNA, 50 bp, Homo sapiens
  Sequence of Binding Site of Probe cg07211259 of the Infinium HumanMethylation450 BeadChip
acaaactgctaaaagcaaaaccaaaactttccaaataagccaggctttcg

SEQ ID NO: 32 - DNA, 106 bp, Homo sapiens
  Genomic Location of the ACTB Amplicaon
cccttgaaggttgcagaggccacagcctggtgggaaagatgaccaccacccagcacacagtggcagacacaggttcacagtccagaagacttgctgagcctcctcc

SEQ ID NO: 33 - DNA, 191 bp, Homo sapiens
  Genomic Location of the CD274 Amplicaon
gtataggataggtagtcattcttatgcgactgtgtgttcagaatatagctctgatgctaggctggaggtctggacacgggtccaagtccaccgccagctgcttgctagtaacatgacttgtgtaagttatcccagctgcagcatctaagtaagtctcttcctgcgctaagcaggtccaggatccctgaacg

SEQ ID NO: 34 - DNA, 50 bp, Homo sapiens
  Sequence of Binding Site of Probe cg07676145 of the Infinium HumanMethylation450 BeadChip
cggtctatgagctggggacactgctcttggcagtacacctcatgtcttta

SEQ ID NO: 35 - DNA, 50 bp, Homo sapiens
  Sequence of Binding Site of Probe ch.10.1529706R of the Infinium HumanMethylation450 BeadChip
ttcattcatttgttcatccaacaccaagtatgtgttatgtgtgaggcctg

SEQ ID NO: 36 - DNA, 21525 bp, Homo sapiens
  1st Regulatory Region Comprising Enhancers, a Promoter and CTCF Binding Sites of CD274
tcatgctcatggatagaaagaatcaatatcattaaaatggtcatactgcccaaagcaatttacagattcagtgctatttctatcaaactaccagtgacattcttcagagaactagaaagaactattttaaaattcatgtagaaccacaaaagagcctgtatacccaaggcaatcctaagcaaaaagaacaaagctggaggcatcacattacctgacttcaaactatactacaaggctacagtaaccaaaacagcacggtattggtacaaaaacagacacatagacaagtggagcagaatagagagcccagaaataaggccacacacctatgatcttcagcaaagctgacaaaaacaagcaatggggaaaacactccctattcaatatattgtgctaggataactggctagccatatgcagaagcttgaaaatggatcccttccttacattatatacaaaaatcagctcaagatggattaaagacttaaatgtaaaacccaaaactataaaaaccttggaagacaacctaggcaatgccatcctgccataggaatgggcaaggtttcatgacaaagacaccaaaaacaattgcaacaaaagcaaaaattgacaagcaggatctaattaaacttaagagcttctgtacagcaaaagagactatcaacagagtaaacaacctgcagaataggagaaaatatttgcaaactatgaatctgacaaaggtctaatatccaccatctataaggaacttaaatttgcaagagaaaagcaagtattttattttgggaagtgaatccagggaacaggggaggggcccttgagaagagtaaaacaggaaggagggagagctaatccaagagtgtgctgttcagctggctatgcctgtgggtaactggggcttagtcttggtggggatgctttaaggaaccacatagaagacacttcaggattgtcaaccagagagaaaacaggggaacagcctgacctccataggctaaaattaacactggagggtttttattttctctgttttaggagtctcactagaaagcagagaatccctgggataacaagcaagacagacgcatagtacagctgggatgaagtgctggtaagggcacctgtgtagagcctgttgcctcaacaatgtccaggacaaaaaggtgagccaaggggatgtgagaggagtatggcagatgtttaatgtaatgcccaactttgacacttattcattaggtgtatcatttgttcactcttagcacctgtttcttcatcctaaatgaagcaggaggatcacttaccctggctgtttcccagaatgatcattaagagagttgtgaaagcactttgaagcaatttaaaagctaactcactgcaaaactgaaggtggttgatgctattctagacctgaatatgaagcaataccaggaaaacagagaactaagaatagatcacagagagcatctagaaggcctcaggaagtccctgcactgatgtggcagttctgttgttacattaactaagaaaaaaatcaacacagatgccaaagaaagtagagtatatttgggaaaaaaagaattgcaattcaggtacactgaattagggcaacactaaatagtgtcctttaaggcaagttcaggtttttaataggagatttcttgaaaaagttgttttgaggggcaattcactggctggacagaaatcctaaattgcagagctgttctgaattgttagttaattagggtactcccagctgagagatgttgaagtccagtggattctgacttaaggtgttatccaagtctgttggaaccttctgtggcttaacatttagcaggtatgagtgcagtcctctcttgatcttccaattccactttaatgcctaggcctaaattactttatgtcctttcacagcaacaatgggccaggaaggcatgacatgcacaaatgatgacaggcaccacacttagcatcttggaaaatgaatatgtgagtttaacacctcaaggtttttaatagctgaaatattaggagacttttttgctggaaataaatattgattgaactgattcagtaaatgcctaatatatgaggaccgtaattccttatctccctgtcagaccaatttaagatctacattttagccatgtctgtccacctctcagctttagagtttaaattcactttcttctgcagtatttcgacaactgaaagactccagttggatgactaatttcagccctatttgatctgaggatgcaaccggtagctgctctcacatcctcaagttacatgacagttatactttttacttcctcagaacatttgccaacttaataaatgttcaatgccaacattaaattctcccctgagccttagtgtaggtacatgtgcatagatataatcaggattaaccatatttcatatgccgtttcttctcccagtcacttgaagacatcgtggaggcactttgcagaagagaaccaaaagtggtgttgaaatggtaacagatcccaaagcctaacagttgagctcttgcaagcagtggccctacaggttcccctaatatagggtcctaatggttcatcctacttcctttcaggtaccccttcctgaaatgaagaatatgttgcaagggaaaggtttgtaacctaaaactgttgatctagtcttcaataatggcatacatatcatagccactttctctgtgacataaatctcagagaaattgttctttccttcctcagccattgatattatttaaaaccgtgattctatttttaccttcagcttgaacaatctctgcataacaggtatgtttgtatgcatacggcatttcttcctaaaacttcaaaaatcttcaaaaaatatgtaattcttctattttcaaattccgtgagagtctgctctcctcatgtgtatgctttaggagctctgctatttccctaaactaatattacagtggtgtgatgtaccattaactacatggccatggagattcagaggtgaaagcagggattgcctgcatcttttaagtcccagtttgattttgatttcatttcataatagatcttattaatgataaaagttggcggccgggcgcggtggctcacacctgtaatcccagcactttgggaggccgaggcgggcggatcacgaggttaggagattgagaccatcctggctaaaccaggaaccccagcaaaaccctatctctactaaaaatacaaaaaaattagccaggcgtggtggcgggcgcctttggcacagcacacaaatcccctgatcatataatcatagggccctgtctagctttatagcctttggacattactgaccacatcaactttaacctcctgccacacatgcacactcaggggagagggcaaggtacatttggggaactccccctcctcttccccatctcttccttgacttccttcttctctagtcagagtcatccatagtgagccttctgctgcccactggaaactgggttgaaagtcccagctactcgggaggctgaggcaggagaatggcgtgaacctgggagacagagcttgcagttagccgagatcgtgccactgcactccagcctgggcgacagaaagagactctgtctcaaaaaaaaaaaaaaaaaaaaaaacgaaaaacaaaaacaaacaaaaaagaaaacgttggcgtgggtgactttggggattctaggaagagccctggcgctttcaacccagtttccagtgggcagcagaaggctcactatggatgactctgactagagaagaaggaagtcaaggaagagatggggaagaggagggggagttccccaaatgtactttgccctctcccctgagtgtgcatgtgtggcaggaggttaacgttgatgtggtgagtaatgccgaaaggctataaagctagacagggccctatgattatatgatcaggggatttgtgtgctgtgccaaggcttggatggcatcctttgttccagacagaagggtcctgtttattgtcctcctaaggtaatttttgttcactttgtaacttttgctcccatgcactcagcaaacagatattgaccagctactatgtgctagtaagtaagtggtagttgtttgggatacaatagtgagtaaagcatgactcttagcatctgttgtatgtgcatgcatgccatgcatgtgacactgagggagagagagattaaatgatatgacagcatagaggctgggcactgcccaactttccatgtggaattcagagaggtctttatttctctgaagttgagtttaagcttgggtgttctagcgaccagaactgtaatgggaattgtaggtgcagatgaactttgtgtagggttatggttctttctcacagaactattggcacccactgcaaccagctacacaattttctttacaactctgcagcaagctagacaggtcacaggcagtccaacctcaggaggttgcctgtatcatgttgatggtgaagctgacaccatagcatggaaaccagagtccactgctcccacagctcaatgcttagctgtttcaatatgttgtctgaaactgcatcttctaattcctggacttttcagatctgtactgactcagatctgggtggggcttagtttgaaggagggagtccttggtgatgatgtgatttccttggtctgtcataggtagcaaatcaaacgtaccttggactttactctctgagaaactcatagctgaattcaatgtttattcttatggactacttagcatttgactagacggtatgaatttctaagtaaggtaaggatttctttctaagttgtttatacctagaacttaaaagtgggcatgaataaatcaaatatgggtggtttttagttgacactttattttcccgttaggaaaaaattagtgactgatcttttaaattgatttagtgcatatactatgtattgtgcatatgcaccaaacaaatacttagtaaaaggttgtcttgaaggaacatgctgatatatttcaaataaaagaacttagcaaaaatgaggaaaatacctaacattctggtaagacagtgaaagagggatgagcaatgtttgttttgaaaattatctgcgaactttaaaaaaatctctaagagtgtattcttacttgtaattgttcatctagttacactacagagttttattagctgctccaagatgcactgcgttccattctgtggtggaaacaaaaggaccgtagtagtggttatctagcagaagaatcgtgatctttgaattctaatacaagaaacttagaagtctcctagatatttccactgtctcagggaagaatcattaagtttatgtcattttttaataactaaaacaagattcaaaaagttaagattcaattctcattgggtttctattgtttgggactttggataatagaaaaaaatatgaacaggtaatttaggtttttttgtgttactggtacctgacaaaacaaacttgagcttcccatttcctagaaacttggaggaaataatttctgtccagaatggcaaattggtgtcatatcccattataagcatattttaatcaaaagatgcaataaagtgtagtggtcaagatcatagtctctagagtcaagtaatccttggtgcatttacctgcttcatcattaaccagttgtatatttttctcagagccagtttcctaatctgtaaaatgggggtagactagtattgctgtgaagattaaatgaaatttattaaagtgcttagcaaagtgcctggtatgtagaaagtgtttaataaatattattatttcagaatatagatgtaaaagacaaatgatttcctatataatcatattgagtagcctgaaagtttggtggctcttaaataaatccatgaatgaaggctctgcctacttttggcgtgtggcccaccagcatgttctatcagttggcctgagctgggaaagaaaccaattcctgtgttgagttttcctccaggtgcttaaaatagaccatagcttaatattttgatcattaaccagtgattctgggtggcttctccttgctctggtcagtgaccggtgtaggtcacgtagtacagcattaaacaaggtgtttttcctcctgaggttgtcatgtcaactctaaattcccagagacttgcctaggagtggagagtttgttctgagttacataaccagcattctctttgaggctttgaatgtctgtctaactgacttctgactgcaggcatgcaaacttttcccctgcctagtaggaatgaataccccttttccaagtatctgcatagcagcgacccaggggctatccaagagccagttgcttcctgacttaatttctgggaagaccaattgcctattcaagagaaattccttcctccttattcttctgtcagatgagactagctattaggtattccctatctaggactctgacctgactctcctagaaaagaaaatgaggatccaagtccattccgtttaactggggctataaacatatgccaccagaaaaatcctgctattctggcttattataactttaggttctcctttctaacacaatactatctttataacatgtacacacctttccttggtattcagttgtagtgtttatatgttcaaaatccttctaatttagccccaactaaagtttccagtatatatttgcaggccccttttactgcaccatcttcagtaaaatgcatatttctctttcttcagcataggcttcacccttagaagcttgcttttctctggatattcatttccagcaggtctcagagataatgtactgtattgcatctttttctgttggagactagaatgcagttagcaggtgcagcttgttataataactgcagattcagattttttctctctgtaaatactgttaaatgtcccctcagaggctcattttaaaattgagtaacgaatgggggcttgtttttccttagtcctcgatcttggaatcttagagtctgtcattgcacattgctgcttaccatttagagttcaaaccactaattcccaagtgataagagattaagatacaaacctgagataggcaaatgtacacttgcagcttccttgctttaatacttctgtttcaggtgggatgtcttctccatggctatccaggtctgtcctagacaccaccttcgagaaatgagatcctttctatctaatttaacctagattagagacatcaccaagaacaccttctgaaggtgaaaaccttttaccttttctttttgtcccatactctatattccttaactgcaatcactacaatatcctgtcaattacacaaaattaatgttactatgaccaactttgataatatttctatttccaaattgacaaattatattcctaatctaattacattcatgcaaagctagtagctctgtagttatatcaacttggcaacaaggaaaataaacttagtttaaaaaaagactcaaaaagttaaatcacttttgtaaaagacccagaaaaaatatatatatataatcatataactattataatacataaatatataaatgttatataaatataatacatatttattatagataataagtgaaaagggtgaaattgatggagtcagagcttagaaatcttgttagtgtggtgggaggagagaaaggtgaggagtagtcagattatgaagaattccgtcagagtagtatgttctgagttgcaaattcaggggtggaacagaaagttctgggtgataagtgcaggaatctatggaaatgctacgctgagtggagtaaaagtaactagttttggagttcttgactttttcttcctagagttttagatttgctgataagagaggaggaagggacatagaaaactcagatgacccaagtggcaagcatttcttaaatatttcagacccataaaggtacaaattatactctaactcaaccttatatgccctatccagctcaaatactattgacattcgctaggtaccatttcgtgtaggagcaagggtcactctagaataaacttagattctcacagtgagatacagaatccctaaaggtacaggagcgatggcttggaaagagcacagttggatgacgagagtcccagctttattttcagattccagtgtggcgagaagacgggaaaatgagcaactcttcttaagaaaaaggagatagggaaatggcgctttggggaaagaattgagttccatctgaggagggaaagcagcaggaatctgagcaggttttgggtaacaggcagtttattgggtaatgatgttttcagagtacacaaggaagaggtttgaaaggaccaacagaaggggaaggctgggtgggtcgaggggaaacagcacagaacctgggagagacagtgtgtgagaagatgagtaagcaagcgtcctgttcacagcatgaagtaccagcttttgcagagacaggaggcagggtgggaagaaacagcccagggaattcaaggacaacctgccatggggtttcactgtatgcctttgtttcatagaaaggatttcaccacaaggagttgatgagtcaaagattcaggtgcaagtgatttattaaaatagtgctcttagacgaaaccagttagggggtagagaaagccagagtgatgggtagattaggaatataaaccaggtgagccaataataggaaaagcatggtttgctggggcttccaggaaataagcttctctccttaataagaagcgctggtgaagctccagttcttttcgtctgggtttagcggtgtgtgaggtcaggcctgaaacatctacagccacttcattatcacgagggaagctaggttgtgtataaggtaaacccacaggaggcaaagcagagacgtgaaacctagtgacatacgtcctgggtagagctggccagaggctcctagaagcctcagttatgtttctcagaagattccctttgttgtctaagccagttccaggatgttgctcttattgcttgtaacagaaatctaaattcccaaacactttattttaataatgctgtcatatttatctaaatgttctttaatctgggaattgagagtaatcaaaaatgactaatgacatcaaatatttacgtttagcttctaacacagctgaaatatttcatagcagtacaatgaaatgagagaatttcctttctctcattttcactgaaattttctcttcctttcactggaaaggaaggaattatacatgcacaatatctcttctaatttatgtcttctgatcttggagttagtctccttaaaatttgagtgtgaggagacctaggccctccaaaccaatgttccctattgaatttagcgttttattttatatgcaaaacattatatcctaagtgtgctttgtagattacatttctaattcctgttcactcttgtgcttttagtgttgcatgctctgacatagttctgcaagctgtctttgaaaagctttttacctcttctttttactgtacttttgtcttccctgtgaattccagagacgtgactgcagaaatagatgactgaatactaagtatgtataggttctattttcccacttttatttacgtttctgaggattccaaacacgtttgttgttcttgaggcatttcttctagagttatcttcttacagtcttttttattaaggtaactccagttcaattcttaccccttagttcctccccaccccaccacaattttcctcccctgcccccaattatttcaattgtccttgtctcttatattcctattttcttccgtaggctaatttgagagactgcattgtttctctttcccttttggaagttgagggtggcccgtggtagttttaatctgcttggcaaattcttgtaatcttttctcataaggattctacccctttctccctcaactcaagcagcctcaaggtcatcttgcctcctcctttcttcttggaaccaagcagcatgctttacttttcacttcttcctgcttgctaccttaactcctctattgtttctcttctgcttctaaattggtttcatccgagtgactcgagtgactcgcatttaccaagtattgcctatgagctctgtggtttgtgtgctgcctgtacaatataaaaggtaatccacataactgagctgaggtagtgggttgatattctcattttagaagaaagttgagatatgctatagtttaggaaataagacaagtaatctagatttgatttctgtgttgctatttatattagtaatctaattcacacaagaatgtatacttgtgagttacatagatctgatttttatagtagggaaatgaatattaacatgaagattaaacagtctgactttaaaatggtatataaatgagtttgaaagagaaaatacctgatttcattttctgttctgttgtagtaggagggttagtctttcgataacaggtctgaaatagcatgatacctggaaaccatgattactggaaactgtaaatattttaccatccagggttcaacctcctaccccttattctcctgacagtacgctgagacaaacattttattaactaacatctctctcaacattttcccctgctaattgcattttgattggttcaaattccgtgtggggattccttgattctgacagtacaagacattcagttctcttcaagtcatgtaatcgacttttttgaattagttttcagtttcattttgttttccctaattcaagttgggaacacttcattttccccaattcaagttgggaacacttccttggtatttccttgctacatggactttagcaaatgctactttactctccttccagctactcaggaggctgaggcaggagaatcgcttgaacccgggaggcggaggttacagtgagccttttcctagttttactgttggaagcctaactcacaggagagattatgcaatacagtcctgaagtcaagggaggagaggtaggaagggagaggggaaaagaagttccttgagggcatttactagaaatgcctcctggtgctgccttttctgttctgggctagctgtctccttgaaaacagcacacactaataggaaatttaaaaaaaatcctggactcggtatgctctgttgtcttttgtggagaagtcaaagcaccttctttttcttctccacccatgccccatctctttgttgcttgtttaggcaaaaaagtaaaatatttcttccccttatttggcattcaactgcttaattcagttatgtcttggttctgagttttctgtatcaacttttcctacaatgtggaaactttagatcaacagattcaattctgtcttcattttagaaaagttttcttacattgtatttatgtatcaactccttgatttgatgagttcttgacttcaggggccaatatcaattatcctaatactgtgtcatttatgtgctataatgtaacctcatctaattgcattcaatttatgttctatagctcaacctcatctagtgcattcatctctttcatctgaattcatgaagatatcacaaatcttcctctactttggctttcagtgatatcacttctgtactttgctagctctacattcttattagttatctctagaaattttagtccatattttgtttcctcatatctacaatcctcttctcatcctatcattttgtttagcttgtttttgagtacttgttttgttgtgtacatatgctggtcattaatttctaatataaaacatataattattttgtatatttttttctagagggtatagacctaatttaagtgaagttttcctttctgttctttgaactgttttattccaggttgggctttattttttggtcacttgcatgccattcctgtaccccacctattttggattatagtgtatattatgtagcatgtcagttttttattttgcccagttagtggccaggtaattaaatcagttctgacatagtaggtacgtgatgggctcttgatttttttttctcattttgtctgagacctataatccattattgcaaccaccatcgccaccacctcacagcaggtgactctggtggttgggtattttgtgttctctcatttgcttaggctgagttattggcaggggtggaaataaactttttgttagataattgaactgactctcatttttggacctactgaatatcacattccaatgtttatatcatttagttggtggtgtgtatacgcgtgtgtagtgttctaaaggggaatgcactggcgttttgagtggcttctctctgttcaatgtatcattgtataagctatgctcccattgtcatgtcaacgccattgtttatgttcccatttgtttcctactccttcccagtcaagaaagaaagaagaaagatttctctccaaatttaggcattgtgttactttcctcaggctcctttaacaaactaccacaaatatggtggcttaaattaagaaaaacatatcctctcagttctgaaggctagaagtccaaaatcaaggtgttggcaggcccacacttctgaagattctaggggagaatccttccttgttctgccaacttctggcgactcctggtgttccttgtcttgtgtcaatataagttcagtctctgccaccgtctgtgtctcctttcatacctctcataggacttaagacacagcctaatccagtatgatttcatatcagtcttcaccttaattacatctacaaagacctattttcaaataagctcccattctgaggttctaggtggatgtgaaattttgaagaacaaccagtcgatccactacaaatatattagaaaggactttcagggcttcagcaacacaccacaaatctactgtgtctgagagtgggcttcacctccctactaatggtctgttctgcagatcgctaatctctctagatctggtaaattgctccttcagcccaggatgttagggtacttgtccatgttgctagtcttgggggtacagcatcattcttgttagtttcacttaaccctgcctgcagctgtataaatagtcacattagtaaactattgatgattaccacaatatgttgtcatatttgctgcctgagtaggattactggttgactttgcatccttgccttataattgatttttacagggactatttctaatgtttccccattgaagattctgtctgtttttatagggttttcagacatattctttgtcacattaaaaccttttactcatcaatgaggaatttgcaattactttgtacattatctatttttttctgcatggattcagatgattggtttttcaactctaatctgcttaatatgcttttagcctgggttttctagaaaacagaacctgagcaaggattaaaatgctgatgctttatttgggaggttaaaaactcagggctgtgagagagaaggaaagcggaagcaaggcaagggaagatgggcagctttgtaaacggacagattaccatgctggctactgcttcacgagtagtcagaaagacccagcaattctcttggtcgtagcattcatcagtgtgaaggacttttctgaatgggaatgtagaaaaccgtgcctcaaagtcctccacgggaggaaagaagatggggggattcatctgcccagatctagtcgttcctgttggttaaaatttacctcacaggaaataagcagttccatatatcccaatgtcatcatctagtccctttaatagcagctcagagtgctgagtcccatgccctgctgtatagagttccattccattccagaagtatcaggaggaaccagacactccaggtacatgcctggttggctcagctctgggtggtggccaaggaggaaggcttggcactctcagggcaaatgactcaacagagcctcacagtgacagttaaggtcagtgacacatttgagccaaggaaatctgaggcacacagactttggtctgatacatgtgataaatcacatttataaatcttctaatggtaaatcttctttggattcctggagaaaacccaacttggtcactgtggcagccatgaaaatgtgggctcacatctgctgtggggagtgtgggtgattgcagccccaggtgctgctgtctggatcatcaccacctttgtgtcatggccatgactgatctcagctgatgctccactgattattcattccctcagtgattgagcacagtggcaaggctaacaagggaatcctctaatggatgactttggtgcaagggttccccagtcatctaacaaaactttcttagaactgctgcaagcctgacgttcctttcactccatttccacccttcctctctcctttaacatcacagttggaaagttctcctcacttctgctttccccctttatccttcacaggaattttcctcactagcatcccttgaacatcgtgtcccatcttagtgtctgcttcttgtagaacgtgattagcacagtcataatacattatctgttttaatattgttagatttggtttacaacattttgtccagattttcatatctcttttcctgagtgaaatagattatcttctgtcctcatacagtcttttcctgggtttaaataatgctgtccttgaagtttggtagaatttgtctggaaaaccatctgggcctgctcgagctctccctctctctccctctgtgcgtgtgtgtgaaggttttaaactgctatccaatttctttaataattataggactctttaagatttctattttgtgtgtatgtcagttaaggaaagattctcagaaaactgtttttaaatccactggcagaatgttgctgatactattatcttttcacatctctgctttatctgtagttaggccaacttttttaacatactacattttctcacttcattttgccagaagtttgtctattgtcaatttgtagtcttgttaatcaatttttgacttcaaccttttccattgtatatatatatatttttctattttatttccactgttatattttcctgctacttttttgaatttttctttttttgagacagagtctcgctctgtcacacaggctggagtgcaatggcacgatctcggctcactgtaacctccacctcccaggttcaagcaattctcctgcctcaggctcccaagtatctgggattacaggcatccgccaccatgcctggctaacttttgtgtttttagtaaagacagggtttcaccacgttggccaggctggtcttgaactcctgacctcaggtgacctcaggtgagccactgtgcccagccctttttaaaaaaaattttctaacttagattttatactcatttaatatctgcttacctttattcctttttaatacaaatgtttgattaaattctccttaaaactgcttttattgtattctacctctttgtatatgttgtgctttttcatttggttctgagtaataaccatttttatgttagaataattttagagttacagaaaagttatgaagatattataagagttcttgttggccaggcgtggtggctcacggctgtaatctcagtaatttgggaggccgaggcgggtggatcatgaggtaaggagttcgagaccagcctggccaacatggtgaaaccccatctctactaaaaatacaaaaattagccaggcctggtggcaggtgcctgtaatcccagctactcgggaggctgaggcaggagaatcacttgaaacaagaagacggaggttgcagtcagccaagatcacgccactgcacttcagtctgggcaataagagtgaaactctgtctcaaaaaaaaaaaaaagagttcttgttaacttttgcccagcttccactttgttaacattgtatatacatggttcatttgtcaaaacttaagaaattatcatggtacaatactactaactaaactacagattctatttgaaggtcaccagttttcccagtaacttcctttttctgtttcaggatccaatccagaataccacaatgcatttagtaattaggtctttttttttattttcaattttaatttttgtgggtacataacaggtatatatatgtatgagatacatgaaatgttttaatacatgcatgcaatgtaaaataaggacatcatggagaatggggtatccatcctattaagcatttgtcctttgaattacaaataattcaattacactcttaaaattattttaaaatgtgcaattatgttattgattatagtcactctgttgtgctaccacataataggtcttattgattctttctaactattttttgtacccattaaccatccccaccttccccgcaaccaccactacccttcccagcctctggtaacaaacctactctccaggcccatgagtttaatggttttgatttttagatccaacaaacgagtgagaacatgtgacgtttgtctttctgtgcctggcttatttcacttaacataataatctccagctccatccatgtcgttgcaactaattggatctcattcttttttatggctgaatagttactccattgtatatatgtaccacattttcttttatccatttatctgttgatggacacttacgttgcttccaaatcttagctattatgagcagtgctgtaacaaacatagcagtgcaaatatctctttgatatactgatttcctttctcttgggtatatacccagcagtgggattgctggatcatacagtagttcaatttttagttttttaggaacctccaaacttttcttcatactgttgtactaatttagattcccaccaacaaggtatgagcattcccttttctccacatccttgccagcatttgttattgcctgtcttttggatagaagccattttaacgggggtgagatgatatctcattatagttttgatttgcatttctctgatcagtgatgttgagcaccttttcgtatgcctgtttgccatttgtacatcttctgagatatgtctattcaaatcttttgcccatttttttaaattggattattagattttttcctatagagttatttgagctccttatatagtctggtgatgaatcccttgtcagaggggtagtttgcaaatattttctcccattctgtgggttgtctcttcactttgttgattgtttcctttgctatgcggaagctttttaacttgatgtgatcccatttgtccatttttgctttggttgcctgtgcttgtggggtattgctcaagaaatttttccccagaccaatgtcctagagattttccccagtgtttcttgtaaccgtttcatggtttgaggtcttagatttaagtctttaatccacttttatttgatttttgtatatggcaagaggtagggttctagtttcagtcttctgcatatggatatccagttttgcaagcaccatatattgaagagactatcttttccccagtgaatgttcttggtacctttgttgaaaatgaatttactgtacatatgtagatttttttctgggttttctattctgttccactggtctatgtgtctgtttttatgcaagtaccacactgttttgactattatagctctgtagcataatttaaaatcaggtaatgtgattcctcctgttttgttctgtttgcttaggatggctctggtagcagttaggtcttcttagtcttctccaaacttcaagtttctccttttttgtttttttgtgaccttgacagttttgaggtataatgctcaggtaatttgtagactatcttcaatttgactttgtcttatgtttttctcattattagactggggttgtgggttttgtggcagagtactacacaggtgtagtgcccttatcacatgtagggatacataatagcaacatgacttactgataatgttaatctcaatcacatggttaaagtaatgtctgtcagggttttccattataaaattactattttttcccccatgctctggttgttggaactgaatgactaaatccagcccacactcaaggggagggaaattaagctgcccacctcttggaggagggtagtatgtttatatatattatttgaaattatttggtatggaaaaaagttatgtattcaaccatttatgcacattagtggattatttatattacatggattttttattctttgggttataatctaatattataatttattttgctgcttaaaatttctagctgctttggtcattacaggctctttaaagttgatgcctgtgtccttttgacatacccctactttttaaaaattagcactttctttctcctcctcatgactccccaaatttgtattcttataccgcttatatttatctagatcagagaaaatatatttttccagagagaaattaggctaaattaataaaagatgttatattagtcccagttttgatatttataggaaaaacaagtcttacatgaataaaaagcaattatacattttacatattaccttcaggggaaacatacccaaagaattcaaaattcatcaaaaatacctgttaatatatttgtgttattttcatccatcatattctgtagagattaatgacatattgttcccctcttattggaaaaaatcagctggcttaattgttaatttttttgaaatttcttggcaagtcagagtaattcatttggattatcaagagaaatgttcatagtataatgatctgaattctgattctcacaagtcattaatcactgaaaatgaactgcatcccacatccacattggcagtgagaataaatttgcttgtttgttatgattatggatttgatttctcatctcagcacatatagaactggatgcccttgtggtacatctcaaggctgatttgaaagcttgagagaccatcaagaattggatttggggaagaggtgagtatttgctatactatattttactctatgtgtataaattccttgaacagaaaaattttaatacaacatttaaaagacatattcagtcatcatctttagcacaaatgaagttttggcaaatgtatgcagatattcctacacaaaaatactatttcttgcacaagaaatagtattaccattcaccaaaatgcactataaatctggtagagggttgtaacttatagaccttccatgttgttttaaagaaatatagaattaagaacatttacagaaatctgttgtttctcactttaccaagtgtaaataggggtatgtgtctgtatctagcatatgtacttaggaaattgttctactcataacaaacctatggtcttttatcagcggtgtgatttgcaagtagtagagaacaacacctgggaagcttgtctttctgtgttttctaataagcctgtaatcattttgttaagccccttgggatggccttggtctaaactgcctcttgagtaatcccaagtactgacacaactttgcaaataataatcaaagacacatgtaaatatgccaactaaatttggacctatgtttaatgcttacttatgttatttagtgcacagtgaaatatttaaagtgatggctaacattttgaaaacatcaagtaatatcaaacattaagtattatttacccagatataagaaggagaaaatggaaattcaagtgagaggagcatcatggtaaatcagtctgtgccaaaattatgaatgaaatggagctgcattcttgatactaccttcaaaaatcctccaacttttctagagccaagctctagaaaaagcttatccctttttctagatttaagattgggtattgggcacaagaaaggagtgtagctttcaaggttggtcttttccatagttgagaactagaaactgagctagagaaatcatacatggtatatacacatttgattgcagtaactagggcctgacatagatttgattacttctattttaatctcaagagatgtctatgtccccaaactagtttactctacatcatagcagagaaaatggacaaaacacagctgttttggtaagtatataactcacttggtatgaacagaattgtgcagatgtactgcagcggtgtgtcagtgtctgcttatcagttcttgttctcttttctgcccttcctcactctgctatgtgccacattgcaagaaaccacatttcccagactgcctttccctctggcttctgtgtatgtccagccaatggcaggcacaggcggaaaacgggagggctggaggagaggggagggaagaagccacgttccccccattcaccattcttacttcctgaggtgtcctgccagaggctgcctctcttctgcatcctcttagtggctctaatccccccagacggtccagactctcaccagttccttcttctgttatccctccagccttatgggttatagcagcttcttgttactgctaatttctggattgcctcactcacccctattgcttcccagccatcacccatgtggccaattttctgtaagataataaatttcttctttatcaaaaacctgtggtgtttctgctccctggctggaccttgcagactactagctatgtcaagggacagggaaaagtatgaacagtagggcctgttgatgtcctgcccagatccccttttctaggcaggtgcacccaaactccagctgctgtgagtgctggctgctaatggcctttgtatacactcttccagagatttacctttgcccagagatgcctgggaagctatgatgtttccccgggggtggcccatgcccaatgacaggctgatttgaggacaagctggccccttgcagcaagggtgagcaagtctgtggtgccactcaggttccagtgctcctgatgctatgagatagagaccagacctcagccaagctcattttttgcttggcttcttccctttctctgtcctacttccttgattccttacaattttctcctgaaagctcaccctcagtaattccactgcatgataatcaccatttctggctctgcctcaagggaacctgaactaagagtatattttacagagggaatggagaaaatctgtttaatctggtgagatggtgaaatggaggttgtgaacagagcttcaatgtagtgatgatgaaactaaaaaaacacaacagctgaacattcttgaggaacgaacagttgtgggaggactcaacattttgaaattaaggagaaaagtggtgccttgccaaaattaaggtctggagaggctagttttcatggcaaaaggatgatactgtacttctgaccagtgtaatatggcattccaagagttttcaagagtatcaatacctgtggggtagttagaaatgcaagtctgttttaagactagaaatatatattctgtgagataattatataaagacagtttttctcaggcttgagtcatgcacaattctttattttggaaaaaggctggtgtgggtagtcttgtaccaacgagcaggattgtgattcgggggagtgaaaccagcagtgagggaaggtca

SEQ ID NO: 37 - DNA, 50 bp, Homo sapiens
  Sequence of Binding Site of Probe cg24157392 of the Infinium HumanMethylation450 BeadChip
cggtaagcaaatgtaacagcttggtttcatctacgattacccacttcgta

SEQ ID NO: 38 - DNA, 50 bp, Homo sapiens
  Sequence of Binding Site of Probe cg19281794 of the Infinium HumanMethylation450 BeadChip
cggtaagatgaggatgcttattgtcattaaaccagtgaagatttatctca

SEQ ID NO: 39 - DNA, 50 bp, Homo sapiens
  Sequence of Binding Site of Probe cg08460026 of the Infinium HumanMethylation450 BeadChip
ttgaggttgtcttttcgacgtaacagctaaacccacggcttcctttctcg

SEQ ID NO: 40 - DNA, 50 bp, Homo sapiens
  Sequence of Binding Site of Probe cg04153135 of the Infinium HumanMethylation450 BeadChip
agatttcatgaattactataagtaaagtgtccaatacagtgcttagcacg

SEQ ID NO: 41 - DNA, 50 bp, Homo sapiens
  Sequence of Binding Site of Probe cg20652042 of the Infinium HumanMethylation450 BeadChip
ggatctctcagagcctccgactgggtcattttgaactgctccttcagccg

SEQ ID NO: 42 - DNA, 50 bp, Homo sapiens
  Sequence of Binding Site of Probe cg01820374 of the Infinium HumanMethylation450 BeadChip
tcctgggcttgctgtttctgcagccgctttgggtggctccaggtaaaacg

SEQ ID NO: 43 - DNA, 50 bp, Homo sapiens
  Sequence of Binding Site of Probe cg11429292 of the Infinium HumanMethylation450 BeadChip
cagcacttgtccttggccctccggctgcagcagatgcgcacatatgctcg

SEQ ID NO: 44 - DNA, 50 bp, Homo sapiens
  Sequence of Binding Site of Probe cg14292870 of the Infinium HumanMethylation450 BeadChip
cggagcagctctgacctggagctgaggcagccagcagatctcagcagccc

SEQ ID NO: 45 - DNA, 50 bp, Homo sapiens
  Sequence of Binding Site of Probe cg08519865 of the Infinium HumanMethylation450 BeadChip
cttttaaaacctctccagatggacctgacgattaggcttgggatctaccg

SEQ ID NO: 46 - DNA, 50 bp, Homo sapiens
  Sequence of Binding Site of Probe cg09574807 of the Infinium HumanMethylation450 BeadChip
cctcccatccacccgttactgacttttaaaagtcgtagctgagggttccg

SEQ ID NO: 47 - DNA, 50 bp, Homo sapiens
  Sequence of Binding Site of Probe cg19785066 of the Infinium HumanMethylation450 BeadChip
cgcaggaagcaggctagctcctagcccgcctcggcttggcctttgtggga

SEQ ID NO: 48 - DNA, 50 bp, Homo sapiens
  Sequence of Binding Site of Probe cg09053081 of the Infinium HumanMethylation450 BeadChip
cgcgcccacacgagggaatttcctttgaaagagagcgaaattctgagttg

SEQ ID NO: 49 - DNA, 50 bp, Homo sapiens
  Sequence of Binding Site of Probe cg21601405 of the Infinium HumanMethylation450 BeadChip
cgtcctctggggctgcttgctgaccgctgtgagttgtttttgccccgacc

SEQ ID NO: 50 - DNA, 50 bp, Homo sapiens
  Sequence of Binding Site of Probe cg06218285 of the Infinium HumanMethylation450 BeadChip
cgggctgatattcccgacaatgcagccattctaattttatgtagccaggg

SEQ ID NO: 51 - DNA, 50 bp, Homo sapiens
  Sequence of Binding Site of Probe cg14614416 of the Infinium HumanMethylation450 BeadChip
aactccatagtcactgtaatgcaatagctgccattacttgagcacagccg

SEQ ID NO: 52 - DNA, 50 bp, Homo sapiens
  Sequence of Binding Site of Probe cg23959705 of the Infinium HumanMethylation450 BeadChip
cggctgctccaggctgtagatgaacctgcccatcattgagcagctggaga

SEQ ID NO: 53 - DNA, 50 bp, Homo sapiens
  Sequence of Binding Site of Probe cg16117781 of the Infinium HumanMethylation450 BeadChip
cgataaaaataatctgatgataccaagagttatcaggggatgtggagtaa

SEQ ID NO: 54 - DNA, 50 bp, Homo sapiens
  Sequence of Binding Site of Probe cg14153654 of the Infinium HumanMethylation450 BeadChip
agctctgtgacagccctatgaaatcattcatttcatatctgctgaccccg

SEQ ID NO: 55 - DNA, 50 bp, Homo sapiens
  Sequence of Binding Site of Probe cg17123655 of the Infinium HumanMethylation450 BeadChip
atccaggaggacatcaatgtcctacactaaaatttaaatgcgactgaccg

SEQ ID NO: 56 - DNA, 50 bp, Homo sapiens
  Sequence of Binding Site of Probe cg22677498 of the Infinium HumanMethylation450 BeadChip
tctgtttcatcacatcctaagcatctcattctaaaccaagaaataggccg

SEQ ID NO: 57 - DNA, 50 bp, Homo sapiens
  Sequence of Binding Site of Probe cg18025409 of the Infinium HumanMethylation450 BeadChip
cgtccctgcctgataatggcacttcaaattgcttcttggaagcagctctc

SEQ ID NO: 58 - DNA, 50 bp, Homo sapiens; identical to SEQ ID NO: 51
  Sequence of Binding Site of Probe cg06956444 of the Infinium HumanMethylation450 BeadChip

SEQ ID NO: 59 - DNA, 50 bp, Homo sapiens
  Sequence of Binding Site of Probe cg08840010 of the Infinium HumanMethylation450 BeadChip
cgtgattaaacacacagctttgtgccggtttgccaaagtttgagggtgca

SEQ ID NO: 60 - DNA, 50 bp, Homo sapiens
  Sequence of Binding Site of Probe cg16839093 of the Infinium HumanMethylation450 BeadChip
cgggacttcccttggccctgggtctgcagcgggtcctgccgagcttcctt

SEQ ID NO: 61 - DNA, 50 bp, Homo sapiens
  Sequence of Binding Site of Probe cg02771886 of the Infinium HumanMethylation450 BeadChip
cggtcccacaatccttaagaaaaacggtattttgcaagtttgtgtgtgtg

SEQ ID NO: 62 - DNA, 50 bp, Homo sapiens
  Sequence of Binding Site of Probe cg08723913 of the Infinium HumanMethylation450 BeadChip
cgcctaaggctgacttctgtgtcagcttcttgtgggtatgtgagtgccag

SEQ ID NO: 63 - DNA, 50 bp, Homo sapiens
  Sequence of Binding Site of Probe cg17164827 of the Infinium HumanMethylation450 BeadChip
aagatgaaggcacgtgatattattcggtcccacaatccttaagaaaaacg

SEQ ID NO: 64 - DNA, 50 bp, Homo sapiens
  Sequence of Binding Site of Probe cg04885775 of the Infinium HumanMethylation450 BeadChip
cgtttcaactggagataaactgaactgggttcagacactagcacatgctt

SEQ ID NO: 65 - DNA, 50 bp, Homo sapiens
  Sequence of Binding Site of Probe cg23637607 of the Infinium HumanMethylation450 BeadChip
actttggttttccaactttttcaaaccataaaaattaaagcagggcttcg

SEQ ID NO: 66 - DNA, 50 bp, Homo sapiens
  Sequence of Binding Site of Probe cg16358924 of the Infinium HumanMethylation450 BeadChip
cgtgatattattcggtcccacaatccttaagaaaaacggtattttgcaag

SEQ ID NO: 67 - DNA, 50 bp, Homo sapiens
  Sequence of Binding Site of Probe cg23394673 of the Infinium HumanMethylation450 BeadChip
cgcccgtggacccccccaggcggctcctctgccaggcttggccggcccct

SEQ ID NO: 68 - DNA, 50 bp, Homo sapiens
  Sequence of Binding Site of Probe cg08641866 of the Infinium HumanMethylation450 BeadChip
ttaagtaaacgcggtttacttacccgggtaatcgcggcagcagcgcgtcg

SEQ ID NO: 69 - DNA, 50 bp, Homo sapiens
  Sequence of Binding Site of Probe cg06778273 of the Infinium HumanMethylation450 BeadChip
cggggaggatccgggctgcaggcaggagtgcgcggggcagggcccgaccg

SEQ ID NO: 70 - DNA, 50 bp, Homo sapiens
  Sequence of Binding Site of Probe cg03724640 of the Infinium HumanMethylation450 BeadChip
cgaaatcagtcttgctgggagaactgggaaaataaaaaagagatgacccc

SEQ ID NO: 71 - DNA, 50 bp, Homo sapiens
  Sequence of Binding Site of Probecg11384427 of the Infinium HumanMethylation450 BeadChip
cgtttgattatgagactaccccaactccccaagggtgttttgtggtgctg

SEQ ID NO: 72 - DNA, 50 bp, Homo sapiens
  Sequence of Binding Site of Probe cg06495803 of the Infinium HumanMethylation450 BeadChip
gcagctctacaccccttgcttgcaattctgagcattctgtagcaaactcg

SEQ ID NO: 73 - DNA, 2043 bp, Homo sapiens
  cDNA PDCD1-001
acagtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaagga

SEQ ID NO: 74 - DNA, 1019 bp, Homo sapiens
  cDNA PDCD1-002
cggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactgagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtg

SEQ ID NO: 75 - DNA, 366 bp, Homo sapiens
  cDNA PDCD1-003
caacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagggacaataggagccaggcgcaccggccagcccctgaaggaggacccctcagccgtgcctgtgttctctgtggactatggggagctggatttccagtggcg

SEQ ID NO: 76 - DNA, 11398 bp, Homo sapiens
  1st Promoter of CD274
aaccaaacaccgcgtgttctcactcataggtgggaattgaataatgagaacacttggacacatggtggggaacatcacacactggaacctgtcgtggggttgggggaggggggagggaaagcattaggagatatacctaatgtaaatgacgagttaatgggtgcagcacaccaacatggcacatgtatacatatgtaacaaacctgtacgttgtgcacatgcaccctagaacttaaagtataataaaaaaaaagaattctctaatccatggaataagtgttgaataatgaaattctgatattgtgtttaatgatatactgcactattcagaatatttgtacttaccttcgagtctctcttctaaaagatgccaaacccccttacacgaagtagaaaacgtcaaatatctaaatattgtatcttaataatgttcaaacattaaatgtttcaaatattccaatgtttagaatcataaaaaaaaaacataagaattgttttaaaaaaatgctctaaacttaacccacagcccttcttgtgaatttctccaaaataactggagcctggttaatagcaagcctcaggagcatggctttgaaatactgtcaacatactgccaccaatttctccatttccagaaaagactgtaattttttctttagaaatcatgattttcttgattggtttagactggtttccagtagttcacttaccaggaaagtttctgttttgtttttagacttccttaatttagagaatgcacataatattgaaactggctatagtatcctactctggaaaagcatattaaatacatacaaatatatatttaatgtatataaatacaaatatatatgtaatgtatataaatatatacaaatatatgtgtgtgtgagtatgtatcttccttgatttccttttatccattaccactaatatccctcaataagtcctactggttctacttccaaattatattttgaacatgctctacagaaacagctcctaaagattttccagcctccatgaatgtaagtcccctccatattccattcttcgtaccacagctagagtggtatttttagaacattcatcaggcaactaccctgctctaagccatctggtggcttttcattgcaagtagaatgcaacctctcccctagtcctcaaggctcttcatgatatgatttgaccctcccatccctcttcctcactctctacccacaattctcttcttttcatccttggaacttgccaagcttgttccacccgtatagtctttgtacctgtctcttcccatggccaaatatgctcttttggcagatctttccatggttatcttcatgattcatttctcagatatcacctcttacacatttcctgaccaccataactaaaggaacctcacacctgtgcactataccatattgctctgacttgtcttcttttttcttgtataggacttttcggtatctgaaatttttatttattaatttctgtttggaacatatctctctcagagcagaaaggtcttgctgtcctttcaaggaaatggtggggaaaagaaaaattctcattcttttatgatgagcctacaaaaataaatgggttaaatgggttcttgatccagttcaccttaagtgtggttaccaaaggaaatgattcacaaggtgactatttcatttgtgtgacactcacttatgttattagttctaggatattaaatcaagaaatattttctaggatcccctgaaagagtatctctcaattgtaaactttatctttagtggcattttgttgatttattgagattccctagatttaaaatatttaccacagagtgttccccaactcccacagcatttatccaggccataactacttatgtctggatttatgaacttattgtgggtgggggaaattgttggaggtctcatctttgttttaaagtacctgtggcatggggtctgccctttgaaggcaagagctcttcacctgcccagctcttccccagcttaggacaggaaggagagagacacagtgtgagcgagagaagcatctgattgtgagtgtcagatgaggacagctgctactctctggtcacccatacatgttaattacccctgtcatttaaaccattgttttgtgtaactagaacaaagtattctttccacgaagtctgtttgacacgagacacatataggatgtgagtctatgacaagggtaggggcaacaaatgtgaggggttggatggaaacagaggaagagaaatgagcattgcatagggcagtggtttaaaaccctacatgatcaaaaatagaacctggagacaaatcttgatattgtctttatacataataaaatgcattttaaaatattcgatgcaaacaaagcagtttgtcatgtcttttgttttgagtctctttagtatatgctgcttttgaagatcaagaacatttactggaaattgctccttcaccaggaatttgctcacatctcttcaggtccacttataagatcttgaaatcagtcctcctgagatcagtacaaacgaggatcatctctcctgctttagaagcaaaagtggcaagcagggtagacagaggcagaaggaaggatggtactgataaatcagccaaattagatggaagaaagcgaattacagctgtacttgcaaagaactcttggctcattttttcccttaaatattaaatcactagttttcaaaacttcaaatgtgaacatgactcacctgaggacaatgttaaaatgttgacctccaagaccctgcccccaagtttggatcccaggcagaaccctggaatctgtattttaaacattaaccccaagtcgagtgtaatgcaagtaaccatcagagacactctgagaaacagcacattggcaatgatgaatttatatgtctaaaaatgaatagagtagatgttacatgaataggaagtggtggtattcaagatgaccatagtatctagctcttcagccctggctccccactgctcttctcccatctcagcacttctccatctatttcgtccaaataaaaaaattcacacagagtttcaggacttaaccccccactcattaaccatctgttttgctttacatatttttctgaggtaataaaatttctctttttctaaacacagcctgtttttcaatctccgggtagttgatcaattgtatgggaaaatgaatggctgaagggtagaaacaggtgggaaagatgaacaaaaacacgaatcctcacattactaatacgcaaatcactgagcagcaagctgagcaaataccctcaattcccatcagcaactttagagaaaggcaaattccgtttgcctcattgatcatttaggtagaccctgaacactgctttcataaaacaaaaacaaaatacccatccccagtttaaaaaattattcatagatcatccaggccatctaggaggatatgatttaatcctggctacttggtaaattatttgcccaagttaactcagctagttagtggtagatggctctgaagccagttgtttttttttgttttgttttttgcagacctcaagagtcatgatgaactagcagatcataaagtttatgccctgggtcttgaccatttttagaaaaataaaacattaaatgaaaatatcagagggcattgcagatagtagatctaagtattttttcatgaaacttgttgtacatgtgtgtgtcatacacagactatatatatgcagtacctgtaaactgtattgccacataatgtctatattttcctagaggtcacagtcaccaaagttgggaagtcacccaacttcgggaactttgggaagtcacccaaacttacagtcaccaaaattgctctattctactatgtgacctcaaaagtgatttgaaagaaggaacatctgagctgggcccaaaccctattgcaattttattggggccaaagagaactccatgctcctgccaaatcaaggcagtgtcagcctcaataatttcccagataaaaataaaaatctgtgatacaatcagaatgtgaaaattcttattttggaagcaaatgtcataaccaatgcaagggctatctcaatattcattcattatgcagtattttgaactgcagttgaaatgaataagaaggaaaggcaaacaacgaagagtccaatttctcaatttagaaaaagagaaaaaaaagaaaagggagcacacaggcacggtggctcaagcctgtaatatcagcactttggcggatcacttgaggtcaaggagttcgagaaaagagagcacctagaagttcagcgcgggataatacttaagtaaattatgacaccatcgtctgtcatcttgggcccattcactaacccaaagctttcaaaagggctttcttaaccctcacctagaataggcttccgcagccttaatccttagggtggcagaatatcagggaccctgagcattcttaaaagatgtagctcgggatgggaagttcttttaatgacaaagcaaatgaagtttcattatgtcgaggaactttgaggaagtcacagaatccacgatttaaaaatatatttcctattatacacccatacacacacacacacacctactttctagaataaaaaccaaagccatatgggtctgctgctgactttttatatgttgtagagttatatcaagttatgtcaagatgttcagtcaccttgaagaggcttttatcagaaagggggacgcctttctgataaaggttaaggggtaaccttaagctcttacccctctgaaggtaaaatcaaggtgcgttcagatgttggcttgttgtaaatttctttttttattaataacatactaaatgtggatttgctttaatcttcgaaactcttcccggtgaaaatctcatttacaagaaaactggactgacatgtttcactttctgtttcatttctatacacagctttattcctaggacaccaacactagatacctaaactgaaagcttccgccgatttcaccgaaggtcaggaaagtccaacgcccggcaaactggatttgctgccttgggcagaggtgggcgggaccccgcctccgggcctggcgcaacgctgagcagctggcgcgtcccgcgcggccccagttctgcgcagcttcccgaggctccgcaccagccgcgcttctgtccgcctgcaggtagggagcgttgttcctccgcgggtgcccacggcccagtatctctggctagctcgctgggcactttaggacggagggtctctacaccctttctttgggatggagagaggagaagggaaagggaacgcgatggtctagggggcagtagagccaattacctgttggggttaataagaacaggcaatgcatctggccttcctccaggcgcgattcagttttgctctaaaaataatttatacctctaaaaataaataagataggtagtataggataggtagtcattcttatgcgactgtgtgttcagaatatagctctgatgctaggctggaggtctggacacgggtccaagtccaccgccagctgcttgctagtaacatgacttgtgtaagttatcccagctgcagcatctaagtaagtctcttcctgcgctaagcaggtccaggatccctgaacggaatttatttgctctgtccattctgagaacccaaaggagtcctaaaagaggaatggaggagcctaagaataaaaatagtataataaaacatttcttagacacattgaccttggcctatgtcaaagttcagtctgggtttgtcttataacacaaggagtaaaagtaccattgttctacctctttttttaatacttgaaaaaaatttactgtggatgcttttctatgaattaaataaccttctaaaaaatgttttcattgctgcattcgattagattgggtaactaaatgaaattaattcctcactgttgggtataaaggttatttacagtggttctgtcttagccattcactgaactcattgcatatatatctctggaatattgctgattgtttccttcaagtaaacttagaagtgtaactacttagtcaaagagcctgaatattttaaaggccttttgaagaaaactgaaaatgctttccagaaaggatgtatcagttgacaatgacagtcgtcaacagtatttaaggagaactatgatactctgaagaaaaacttagcctttctcagtaaaagtaggtaggcagaggccacatgacagcagttagagtgtggtcttcaaggaagtcacagaaatactgtggggaattgaaaccccatgtggaaaatgtacaagagtgtctcagtgtgactgagaaggaggttgggcatggggtttcatggagtttaataaagtttggtcacttagtagaggtttaataaatcaactgtcttaatctttgatcctacttaagaattttttttttgtttttgtagagatggggctcttgttatgttgcccaggctgttctcgaactcctagcctcaggcgatcctccctcctcaggctccagaagtcctgggattactggcgggagccaccatgcaggcctcttgctcctacttttgagaaaggaagtttaaccggttttttttgtctttttttttttttttttgagacagagtctcactctgttgcccatgctggagtgcagtggtgcaatctcagctcactgcctcccgggttcaagtgattctcctgcctcagcctcccgagtagctgggactacaggcacctgccaccacgcccagctaatttttgtatttttagtagaaatggggtttcaccatattggccaggctgatctcgaactcctgacctcaggtgatccgcctgcctcggcctcccaaagtgctgggattacaggcatgagccactgctcctggctgcttaactttttctctatctcatcctcctacccatcctacccttggaagatagagaagtagtattagttccatagtgttatactgggcttcccccagggacaaacccacttccccaacctgaatgagccatcacttcttccccagtttacatttcattgctctttaaatgtctccattcggatatgggaattcacatatggtcataattcttacctgaagaagatgtcagtcttcttctcttagaccaactgccctgatatgaggtttagaggttaaagaacatgtgtgtatttacatgatctttgtattctgccttttcgtccctcactaatgacagctgcaccccaaggaaatggagctgtggaagagagggtttgataagaaattaagtaaatattggatctaatccatcaccctccaggaagcctttattactcctaaaaatttcaaccaaattcattaaaggacaagaactccaccagagtaggccataaacattggcaaaattagttgtaatccatgactagatttaatgtccctttgttttattcccatatggttataatgctttgcttggcattaggggtattttaagttttcttctgcctagtaagtgaatttgtgtttataatacaataatcataaaatatcacattaatattttataactgtacagttataaaatattttataagtaatatttatattttataagtaatattttataactgtacagttaactctggcccaaggaaaagatagtctgatagatgctgcagccccattttagcaaatgtgacctcacaggcctgaatgccatcgctattccacatctacaggatagacggaaaggaaagaaataaaaaaataggtacctaacactggcaagaggatgatgactcatgttatttcacttaacctttttatcttttaacatgaaggactcatacaggttgataagaaaccagtgacataaacagaccaaaaaatgatcagatctttcaaattagcaaaaaaataatattttttaaacaatgggtgaaaatacagtgtaacagtaccaattatcaacatgtgttgagaaccagaaaaatgttctttttctttgatcagcaacactatttgggaaaatctatcctcagggcctagcctggggccctggcacacagtaggcactcaacgaatatttgctgaacacacaaatacttatgatattttaaaaaattggcaacaatctgatacctaacaatagagggattaaatattatggaactgttaaataagatgcttatgaataccatgcagtaagatgggcaatatttatgccataagctttaatgaaacaaatgggtattaaatgtatgataaggttataaattactttttaaaagattacagggaaaaaaattgaaagatatacactgaaatgttttttgctcacagtggtgacaaggtttctcagcactggcactgttgacgttttaggctgtatgtctttgctgtgggaggctggcctgtgcactgcagggtgtttggcagcactcttggcctctgcccctagatagcaatagcagtcctccctcaaccagcccaattttgacaaccaaaaatgtttccaggcatcaccagatgctccctgggtgagagtgatgaaatagtaggggattttccccttcttttcttattttctgtaattccattatattactttaataataaagaaaaaaacataaaaaataaacgaatgttattattctacgtcagtttggatgtttggactccattttggggttctttccattatatcacttggtctgctaaacattctacggtttggtaaggtgaagtgattcatgaaattttggttttatttttttcctgatactaaaaataaaacattctttcacttggaaatttggacacagaacaccaaaaaaaatccataatctcatctctctttttctgtcttttccttccttttttccctttaaaaacaataaagagtgaaacctacctgttctccctctaatttaattcctaaatataatcactgtcaatatcttggacatttcctgtgtctaaacacacacacacacttttttttttcagcaaaagtggatttctgctacatgtagtgttctgcaacttactttctatgtgtttacaaaatcagtacatgtacatatgctgaattcagtccttaatggtattatattttgtgaatataccaaaatttgtttaaccacttagacaatctaggatattctcagtttgctgttatgagcaatgctcttcctttacatatacagacatatatatatatatgtgtgtgtgtgtgtttttgttttagtaggatagatttctaggagagggtgaaaggtcttatgacatccgcatttacgattgtaataggaagtatcaaagtgccccctaaagaaaaaaatcctcccattagtgggtaagaaagcctatttgttcatatcttcacaaacactaaatattagaaatatttacaattgtggtcaagctcataagtgaaaatggtatttcatatcttatattttttattgtgagattgaacatctttcatatgtttacatgtcacctgtatttcttattctctgaactatatgttatgacctttcactttttttcctcatgggttatgtgtagtttgtatagttgtcttattgattgttaggagctatttatatattaggaacattaatctcctgtcttatatatacgtggcatcgattagttgatcatttgtgagttcatgtctgtatacaaagattggagaggcactaagagggaaaacttacctctttcttatcaaagtttgtaaatatatgtataacagaagagggagaaaatattaataaatgcacagattggctgaaatagagtataaatcttttactcccctacttcaacataaactgcaaaaggagagtgacttttctttcactctgacttccgtattcctcatgcttaaaatagtgcctagcacagaagaggtgctcaatcagtgtttgctaaacgaaataattagtcacatttcaagcaggatgactaaatgaagaatagaatctaggcagatactctggaagagtggctgtgagtcattcatatcttagtatgaattagtcaaatccaactctctccccttcccactccccactgttagtagaagaatctgtttattgagagaatagatttataatttagaataagtgagaggggcagaagaggagattttgaaggatggcacctgaaggaggactagcatggctgagacagtgaagtggaagccttgaatagctaaagggtaagatgaaagtatttagctgtagggggaaaaagcattgacaggttggaaaagtaaaagtcagattctccttgctctgaaattttgtacagggcaggttctactaggtatgttacaatgcagaaaaaacatgaaataattgagaggaatttggtgcaatattatcttcttggcttcttttgagtgggcagatttttttcacggcctgtaactataataaatttgaaacttctcatcttttagtaacttttttcacttaagtttatgtggctgtgggcaatggaatgaagatattgaacttccaattccctgttgggtttccacaattacaagtcaatcatgactggttattagaagactatttcagttagaaccaccaagtcccatattgtcatattgtatgtttaattattaagtgaagcagtcttcttttcgtgttttccataattagggcattccagaaagatgaggatatttgctgtctttatattcatgacctactggcatttgctgaacggtaagacaccaaatccttccattaggttctatattttaaatattttaaccatgagtttaaaactaaaatgatcatttaaaatgcatgcaattttcttatagagagaacattctattctttcttctactttacacaatggcaaagtcttctttctactttacgcaatgataaagttacctgtgtcattttgtaaaaatatagagaatatagacaaattgaaagacacaaaataatctattacccatttcccagggttaactactgaaaatatctggggaaatggcctgtatgtatacatttatttgtttgctttcaacaaggccaagatcctttgatctttcagtcttggttgctctgtgacatgcctttcctgatgaggatactttaaggaagaattgtaagatacatggaaaatgtcaggctaacacagtactggcatcaccctgtgctctttcctgaactccataccaatgtacttcttgccagaaaactgatcaaaagtttagggaagtaaaaagagatgactgttagaatctaccattccctctatgtaggaagcaaataggtgtcctgtcaaaggacattctggggatgtctacatgaaaccaagtctccctggttgtaaggactccat

SEQ ID NO: 77 - DNA, 3320 bp, Homo sapiens
  2nd Promoter of CD274
ccatacttactgggcatatattcatcttgaaaatctatactgatgttgtcttggggaattgaaaaggaactaggagtgttagttcctcggtattgacccacagttatgttatcaggtcacttgagttcaaagttttgtgttggcactagctaagtaaaggaaaacacctctgctttcattgttgagtttcacagaattgagagctgaaaggatcccaggcaggagcagctaatccaaactcccacaaagaacaaaaatcccccagaggatcttctgttcttatatttcctgcaatggcgtccctgtcatatcccacaatggcctccctgccatttggatatcccttccatatcctgttgaaattactccctaatagtaagctgaaatctgcccctctagttgtagtcttgggattatttcatttacatgatgaccttttaatatttgactagaattaaatcatctccccttggtctttccattcctgggctaactaccatcaatctgagggctaacaatacaagtagaaaaagtatacatttgtcactgatcactgatcaattattaatcaatgatcactgataactataaactcaaaaacaaaatcatgtggggattaagagaaatgtatcagttttatgttgtatttctggtccctgatactggctcaggtaatgccactattgtcaagaagataccacttgtaaagtagatttaattttcattatattttaccatatgcttctccattcatgacatctcttgagatgttgtggtttatactttcagtttttctccagtccatccgcaaatatcaggcatctactgtgttccaagatattaaagaaatcatcatgacttagcctcatcaacagcattgctagatctgggatggaaaggaagagtataatcctggcagtcaggaagaaggcagcataaagtataagtttctgcttccaaaaaaggtctctcatcagcctgtagggagtgtgtagggaagggacagctgtccttgtagtagggaagggttttattcaggtcgtctgggctccataatatcccttgtgtatctgcagtctcctttgccatggatcaacacaataggaaatcttccggcactgatggtttttccaagggggagttcttcctggagcaaagcaaatgaccaaccaggtttgaggacctgatttgtttgacaattccattttgtattgtaaattacttaattggcattctactcccaatccatcttgtcatttgcatacagtggttttgggattgagttcagctataccaaaagtctgaaccttctgcacttagaacaaggcaaccaccaagcttcacttgcactgaggccgtgtctccaatggaaatgaggcagctggcttgcaggagcttcccaactcagggaagtagaactcctgagtcacctccatatgcaaatgatttcacagtaatgctgttgaacttcacttcccatcacagcaaatgtgtggtaacatagcttccccacaggagtttactcaccatggtattttaaaggtgaaacatttcaaaactgaaatttgaaagaatttagttttggattcactcaattatcactatcacttcgggtgttattgcacctttcttgtttgtgagtttaaatgccagactctcaggccactaactttcaattaaaagtgtttttctttaatcgctgaacctaacagcagggaaaacgaaatgttcattcagactttcagaaccttcaatgagattaggcagctgaaagatcaaagtgttgcatagttgtcccgataaagctatttggatcatatggaccaaatcgactgctgtcattccccaccaaccccatctctccccaaaattcccagccctgtttaagtgttctctgtagcatttatctctatctagtatattgtgtagcatatcatatcatacttttctgttttgtttattgtctctctcctcctagaatataaactccacaagcacaaagatttgggcctgttttataatattgttgcatccccagggcctgatatacagcagagtggtggtacgaaaagagcacacaaaaaaatatttgttgagtcaatgaatgaatgatttcctcaaataggattagcctaaaattttggaaacatgaacagatttggatatgtgaaaatttatttccagactgttcatcaggaactgttagcagcttctaaagggtacactggagcagcagtagtaaaaggaggaagaggagcagctctgctactgctactatcgagtactactacaattagcacttgcttattctgtgtgttaggccctgtactgaacactctgtctaaattagttcatttcctcctggaaatgactctagggggtaagtgcttcatcatgtaagatgagtatttttcacattttgttgtgtctgaaatctgagtgtgtctttcaatgatggaatctttgattccatgataagtggtattattcccattttaaggatgaggaaactgaggtccaaagaaattaagtaatttgcccaaattcacccagcctagaaaatgataaagctagttctaaacccaagcagattagctctgaagtctgggcccttaataaccactttttattgcctatatttgtacctctggtgtacgtatcaagttatatgttgacttcaaaactatcatgaccttttcttggttttgattgtccaacattagtatagtgttctgggtctgcaaaaattttgattactcatctcatctgtaaaacattttgaactcgtgtgtttgtgcatgcacatttgtgtgtaattataaaaattttactttctgttaatatataagttgtatcataagaaactgccgtttttgaagagcaaaaaaaggttgaatgttaccagttacatctggttcaacctaatagacatttgtacaaaaacagacattttaagaggttgaaataaaaatttaataaacaatattttcagtttttactaattgtgatgcttcactatcattagctaatatgtcaaggcataatataccttagggtgaactttatcattaacaaaggtggatggtgtcaataatcttgaggtttgtgtttttttatataacactgcgaggtctaattaagtacttactgtttaccacctcatacagtggccgataaaaagtgtcacttctgctgtttcctctgggttgtgcttgaattattagtattatcttcagtcctcagtttctttgtgggaaactttttaattagttgtttaattttgtaagatggttagtttagtcaaaattagataagagaat

SEQ ID NO: 78 - DNA, 581 bp, Homo sapiens
  1st CD274 Enhancer
tggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatggtaagaattattatagatgagaggcctgatctttattgaaaacatattccaagtgttgaagacttttcattcttgtaagtccatacttattttcaaacagaacagcatagtctgttcattcattcattcaattcatgaattcattcacataattatccaatttcttgagcacctatttgatagtcactggaaatccagagacaaacaacacagagccatgttctacagtatgtacagttttccaaaaagaatttctagtctttacttttttattacaaatgg

SEQ ID NO: 79 - DNA, 4767 bp, Homo sapiens
  2nd CD274 Enhancer
ggcaggaaataaatggaacatatttttctatcttatgccaaacatgagggaccctttctccccggtgcctctcccaaggtagtctacaatatttcaactctagcagtctgcttagtgcatagaacatgaggctgtgtgtccctgggcaaattactagacttctgtgtgcttcactttccctgtaggattataatctactgagcaagcttattgtaagggtcagattagcaacagtgtatgaaaatgatttgagaccattgcctgcacaaattcaactatttttttttatctcactactctacagaagtaggtagggtgggagacagagtctgatgagaggctcagaatgtgaaagaaagtgaggcgagtgagcatgatatttaatataaacacaaagatattctgagaagagctgctcactgccccctcccccaatacatgttgataggaaaatgccacgtacttcagcaaaaacaactgaaaaattagatagaaaagtcaatcaataggaaaagataatccaggacggtgttgtgaacagaaagagggggaaaaaactttagaaaatgatggggatgctcttactggggtacgagtcctcaggtattgaactggctttcagtaaaagctagattagtgggttcctgccatttacaagctgttttatgacaacttacttgttgggtggcctacagtaactcacctaactgcactgagtctgtttcctcatctgtaaattggggatttttttttaaatacctggcatgcctaactcataaagttgttctgaaactgaaataaaacatacgtgaacaggcattgtaaactgtaagttacggaaaaagctggctgttgttgtgtctttaaagtttcacctgggtagtcaaagatggatcatgggtctcagtggagagctgagccaggcaggagctgactaagggtgagaggtgggagttagcagcctctgaacatctgtgtaccatgggaccccctttcctcctgcatggtaccccagacaaggagcctagtaagagatactaatggcttgttgtccagagatgttcaaactgcagagaaagataagacaacaagcattggcctccaatcatgatgacagataggaggaggtgggagctccttagcagtgctggttggccttccatgttctactgtgggccatctctgccatgtactgtaggctactagcttctatattaaagaatgcaagaggggccaggagcggaggctcatgcctgtaatctcagcactttgggaggccaaggtgggcagatcacttgaggtcaggagtttgtgaccagcctggccaacatggtgaaactctgcctttactaaaaatataaaaattagctgggtgtggtggtgtgcacctgtaatcccagctactcgggagactgaggcacaagaattgcttgaacctgggaggcggaagttgcagtgagcccagattgcgccactgcactccaccctgggcaacagagaaagactctgcctcaaaaaaaaaaaaaaaaagcaagaggaagtgaaataatcaaggccgccatttaatagtgagcagccactccatgtggtactgtgcaagcacattataaatattagcctcacaagaaatgtattagcatttgtattttgtacactggttaagtatcttgcccaagacctcaaaactggttaagggcagcagaatttagccccagcaccaccttttcaaagcctgggcttctcacacttctccatgctgttcccattttaacacaggtatctcgccattccagccactcaaactttggcatttaagaaaattatcctaaagctaaactaaacttcaaggatgaccattctcctgaccccttcccatcaaaattttatctttagtcagtttgttttcgttttgttttgtttttcagaactacctctggcacatcctccaaatgaaaggactcacttggtaattctgggagccatcttattatgccttggtgtagcactgacattcatcttccgtttaagaaaaggtagtatttccttaattgcagtggtctccactgggggtgaggaaggggtgagaattggatcatggctgcaaggaaacccgacttaacctctgcaaggtggtgcaaaggcattccactgttcaacagcaattatattgaagctgagtgggatcactgggtgaagatgaagcgtaaggggtgaggggcaggagaatgggtatggatggaggtagaagatgcagtgtcatacagtttttttctatcatgaaaataaccacagacttacagaagagaaagagctaaaatgcccgtcattttcagttgcattttagtcttgcattagttgcaaccagctggtttctgggtaccctaagtaataaaaatagttcctctgtagaactgtagtatgtttaccatagagtattttgcaaaatttttggtagaggatgttacataatttgcatgtgttcatttctccatttacctgtgggaacaattaaaatccaggaaaatgagtatattcaaataatttcctcccatttaagatgagtcagagtaaataattcctccaatacttagagaagtataccaagagatccagtgatggtatagagttgtctgatgttaaatagggaagtagaatatggaaggggattccaatagtcgttgaaaaattccccataaccccttacatgggggaaagtagtgttaactgagagagtagagataagctgtttccaaaaattatattcttaacaggactgagatagccagaatataaggatcaagtttcaatgacagtaagatcctgagatggagttgatttgcacaaagaaataattgttgccagcatgcattttgaatatttctctggaaaaaaagattagttggcagtagaaatggatagaaatcaatagatattaaaatacctcagaatttggttcatctctgggaaaagatgaaaaataaaagtgtatactcctcaagaacatctaggatcaaaagcatgtgccctacactattgaattaattaacctcataagttgggacctgtggaataaggatgtccaccagacttcctagggattacaaatgtttcacagaacttgaaatttaaacttgggtcactgtatgggatgtagagctgtgctatatggaaataaaaatgatttctttttctcaagggagaatgatggatgtgaaaaaatgtggcatccaagatacaaactcaaagaagcaaagtggtaagaatatcagaaggaattgggaagtaaaagtcaaaggaaacaaaaagctaaagcaataacaaagagaaatccatcagtcataatctcctctccttttaaagaatgctggttcccctttgcctcacagctaacacaagaactcctccaccgtctgaggaggtttaggagcagggaaggggaaggagtcagcttcatttgctaatcttctgttgccctgcaccctagcagctccttgcagcaggggacaaggatgacttaggtggatggataattaattgattctaaaatattgtgtgtcagtattgtaatactatgttaattgcaccatgcacggtatctcatttaatcccccaccccttgccattaccaaagagagagagagagagagagagagaaatactagaatttatcctcattttacagtagagaaaacagagggtcaagaagataatgtaaagtgcccaagaacacacagctgatcacaaaaatcaagcttgggggccattagcctaaccacagacccttactcttaacccatctgcttcaatccattttgctacaaatgtttacatttataagcagggcagaaaaacctcatccaggttattgaactaagaagaaagttatattaaggtttctaatttttttaatgtagttagaaaccaaacttaacaatgagcccaagtttaaagcagtctaattaacctggacaagctcaggcaagtttcattctgtggcccatagcatcatctgtgttgtaaagctaagtagcaaatgttgtttgggtcatgctgggggacaagccatcccaatttgctcaggactgaggggttttccaggatatcatgtaaggataattgggtacaaatataacctgctgctttctctcatttcaaatttatcatttatcatatcagcaactatgagttatgttttttattagatttcttgttactttttccccagaccacttcccatgaaattaatatactattatcactctccagatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgag

SEQ ID NO: 80 - DNA, 1139 bp, Homo sapiens
  3rd CD274 Enhancer
aacattcagggtgggaagatcctctctaaactgacttagcaggattcttgccaacactgattctgcaaggatgaacactgcagcccaaggtcaatatctaatcaaggagatggcttagaggagcctgactaaagtttggtcgaggagaaatcttgtcagactctgtcattctcatatgtaagggatgagctgctcttcatctgagcaaaggaaaagaataaattctgggtgacaaaacaattagactgtctaggttttctgtttgccttccatcatattcattctcctcacttccctgccctgttctataccccaaagctgacctctttggacggcaccacctgggctctcctcagctggtttccatttgagtttggacagcgggaggcattcagggagatgggaggcaggaggaaaaagacatcagggtatattttctctgttctttctctgtttggggctgagtatctggtggtggttgtgtttctccacaattgcagctcttggcaagcagtcccttctccatggctccagctccatgggctctggaaacacttttctcctttgctatgtagcctagagagagcgcagtcttcctgctgttgctagactctggatgactcaactggatggttctcttagtcatactcctttaagtagtgtcttcactaatatctctttaatcaaaccaactgagtaaaattctgattcctgatggatacatgttaaaccgaaaacacacattataaattttcttgtatgtatgatgtttttcataattttaaaacataagtgaaaaaagtgaccatagaaaaatatgcccaggaaattgaaaaaaaaagtcttggtatagatattggacacattttataaaatgtggagtaagagggttaaaggaaatttatttcagaatcaaatggcatataactttaactggtatgtgaattattttcagttgtatgaatttgtgaatatatatgtgtacatttttatgcatatatataaatatgtgttttatatcatcttgcattataacataaggatttttatgttgctacattgcatttatatttaccatttttaacagctaaaggattttcaataagtgtgtatgtaacaacttccattgctggatattt

SEQ ID NO: 81 - DNA, 959 bp, Homo sapiens
  4th CD274 Enhancer
tcttactccagtctatcattggtggacatttgggttggttccaagtctttgctattgtgaatagtgctgcaataaacatacatgtgcatgtgtctttatagcagcatgatttataatcctttgggtatatacccagtaatgggatggctgggtcaaatggtatttctagttctagatccctgaggaattgccacactgtcttccacaatggttgaactagtttacactcccaccaacagtgtaaaagcgttcctatttctccacatcctctccagcacctgttgtttcctgactttttaatgatcgccattctaactggtgtgagatggtatctcattgtggttttgatttgtatttctctgatggccagtgatggtgagctttttttcatgtgtctgttggctgcataaatgtcttcttttgagaagtgtctgttcatatccttcacccactttttgatggggttgtttgattttttcttgtagatttgtttaagttctttgtagattctggatattagccctttgtcagatgggtagattgtaaaaatgttctcccattctgtaggttgcctgttcactctgatggtagtttcttttgctgtgcagaagctctttagtttaattagatcccatttgtcaattttggcttttgttgccattgcttccagtgttttagtcatgaagtccttgcccatgcctatgtcctgaatggtattgcttaggttttcttctagggtatttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtggatgtgtggtattatttctgagggctct

SEQ ID NO: 82 - DNA, 466 bp, Homo sapiens
  1st CD274 CTCF Binding Site
ctctttggacggcaccacctgggctctcctcagctggtttccatttgagtttggacagcgggaggcattcagggagatgggaggcaggaggaaaaagacatcagggtatattttctctgttctttctctgtttggggctgagtatctggtggtggttgtgtttctccacaattgcagctcttggcaagcagtcccttctccatggctccagctccatgggctctggaaacacttttctcctttgctatgtagcctagagagagcgcagtcttcctgctgttgctagactctggatgactcaactggatggttctcttagtcatactcctttaagtagtgtcttcactaatatctctttaatcaaaccaactgagtaaaattctgattcctgatggatacatgttaaaccgaaaacacacattataaattttcttgtatgtatgatgtttttcataattttaaaaca

SEQ ID NO: 83 - DNA, 546 bp, Homo sapiens
  2nd CD274 CTCF Binding Site
ttaccactaatatccctcaataagtcctactggttctacttccaaattatattttgaacatgctctacagaaacagctcctaaagattttccagcctccatgaatgtaagtcccctccatattccattcttcgtaccacagctagagtggtatttttagaacattcatcaggcaactaccctgctctaagccatctggtggcttttcattgcaagtagaatgcaacctctcccctagtcctcaaggctcttcatgatatgatttgaccctcccatccctcttcctcactctctacccacaattctcttcttttcatccttggaacttgccaagcttgttccacccgtatagtctttgtacctgtctcttcccatggccaaatatgctcttttggcagatctttccatggttatcttcatgattcatttctcagatatcacctcttacacatttcctgaccaccataactaaaggaacctcacacctgtgcactataccatattgctctgacttgtcttcttttttcttgtataggacttttcggta

SEQ ID NO: 84 - DNA, 15755 bp, Homo sapiens
  1st Promoter of PDCD1LG2
caggaggctgaggcaggagaatggcatgaacccaggaggtggagcttgcagtgagctgagatctcaccactgtactccagcctggaagacagagtgagactccatctcaaaaaaaaaaagttaataaacaacatgctgacaaggttatggagaaaagggaatgcttatacactattggtggagtgtaaattagttcaaccattatggaaagcagtgtggcaattcctcaaagagctaaaaacagaactaccattcaatccagcaatcccattactgggtatatacccaaagaaatgtaaatcattctatcacaaagacacatgcacacacatgttcatcatagcactattcacaatagcaaagacatggaatcaacctaaatgcccatcaacgacagactggataaagaaaatgtggtacatatacaccaaggaatactatagagccgtaaaaaagagcatgtcctttgcgggaacatggatggagctggaagtcattatgcttagcaaattaatgcaggaacagaaaaccaaataccacatgtgttcacatataagtgggagctaagtgataagaacacatggacacaaagaggggaacaacacaaactggagcctagctgagggtggaggccccagggaggagggagatgagcaaaaaaaaaaaaaaaaaaaaaaaaaaaaaaaaaaaaaatgactgggttctaggcttagtatctaggggacaaaataatctgtatgacaaacctccatgacacgagtttacctatgtaaaataaaagtttaacaaaaaactaaaaaagttacctatgtaaaacaaaagtttaacaaaaaactaaaaaaagttacctccacccagaaatgcctttattaacactttggtttgtaaccctccattattttctctagacatatagatttatgaggcaggctaatgtgctgagacactagcttgagtttcatttggccttgctgtgaatatacctgggccttcctttgcttcaggatgccctaaactgtggcaaagcagagctgaactgcccaaaggaaagtgtgaagaggagaggcaggccaagcctggagaaaggctacccaagagagaggaaaggaaactgtggtgagtgcacctcactcctaaagaaggacaggaactctggtaggtgaggtgtgttttccatagatactaaaactcaaagccacacaggggacatatgtccattcctcagccagtcactgtggccaggaacagagggtcaggtaagagaatggcaactcctaaggaaaccacatgcctggagccgtgggtgtagaagcagatccccagaggaagcacgggtcccacagacacagtcccaactcttgccgtctaggcagccactcccatctgtaggtactacacagcttcgtagtacttcttaaagtacttcttgttcaagcgatgggacgaaaagaggatgcaggacaaggaggaggaaaggagatccttgcttttgtagaagaaacaaggaggcagggaaggcttagaggacaggcaaggagagatgttttcttaaaaacatcctctgtctgagtgttcagccccacatctctgctggtcctacccctataagcacaaggaaaagggcgggaggcagcaggagaaggattgatcattcaggcctatattcaagtttgccttttcttgccatgtggttttaatctcaccaatcacaagcctgaaggtatagtggggccactgaggtccgagttcaaattcagccatgcaactaaggaaacattgtttgatcttggtcctgttttctcatgtgtaaaatgggtctaactctaaaccacacattgcactgagaatgaaatgaggcactatgaaatgaagtgaggttagttgaataatgttccccccaaattcatgtctactgaggacctcagaatgtgactatatttggaagtagggtctacgcagatgtagtctaaatgaggtcatactgcattagggtgggcactaatcaaacggatggtatcctcataagaggagaggaatgtagagatacacacagaaaagaatgtcatttgaagatggaggcagagattggagtgatacaactataagtcagggaatgccaaggacttgaggtcatgtgttacagaagccctaggaaatgagtcaatttcctggcacagcactaagacatgctggtattcttcattccatccctttcccctattcctaaatgtgctccagggacaatggggaagctggagcacatataagaataggggaaagagagggaataaaagggtattaaaaactctcaaggtatgttaaaaaaaagactctcaacaaaccaggtattgaaggaacatacctcaaaataataagagccatctatgatgaacccacagccaacatcacactgaataggcaaaagctggaaggatgccccttgaaaaccggcacaagacaaggctgccttctctcaccactcctattcaccatactattggaagtcctggccagagcaatcaggcaagagaaagaaagaaaaggcatccaagaaggaagagaggaagtcaaactacccatgtttgcagatgacataattttatatctagaaaatcccacagtctcagcccaaaagctccttaagctgataaacttcagaaagtttcaggatcccacatgaacatacaaaaatcactagtattcctaaacaccaaccatagctaagccaagagccaaatcaggaatgcaatcccattcacagacaaactgctaaaagcaaaaccaaaactttccaaataagccaggctttcgtcagttcctcagaactagttctggtttgactcactctcatgttacggcaaaccttaagctgaatgaacaacttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatgtgagtaacgagtgggttgagatactctcatactattatgttgtggaccatgatgaggctgccagggtgggggaagggtggcctaccttctctccacaccatttgaggcaagagacattctgcctcagaaattgtgctgaggggcacaaataagctaatgtcctcctgccccagatttctctcacttgttcctatgcatattgttcttgttgctcagttttataaggtgagatattttctgcaccaaatatgtgcactgtaaaataatataactattcttaagattgtctctcagcttagagttttcggaggcttaatggtgaagaacttaaaaatctgttttcctatgactgacatctgtttgtgattatccatttagcagacggtgatccctccaggctggcctttgtttacaagctatgcctaagaggcagctgttggtggagggggaacaaaaacaaaaaacccaaaactattatcttaataacttatagaggtaatcattattgaacaaaagcatgatttggggactatggaaaggcttattctttccatataaaatgatcagcgaaaaggtagaaaaattaaacagaactgaaataattgctattgattgctcaccgcctggatgcactgagtagaagagcaaaggcaatgggttcatgtggaggggatggaggtggagaggctaagcctgagtgagattaccaactaatcaggacttttaacccaaaaatactatggctctgaggggcagggaatgagagacctaaattgacaaaatgcagagtaaaaatattcagtgtgagcagtaatgagacagttgtatcagggtcaaatacggagttggcctggatgtcctccaagctcctttccaagcctaagattctgtgagtggatgaacaatcctggtcctgctgctcttgccactggaacctgatctatttgccttcattatttgaggtctccccatcatcaggctctttgttgtctgctgcttcagggtgtcttctccccagatttctcctgttggtgagcttttccattgaactggagctcctcacaggcaagaagcacacctttaaggttctctgagtcccaagttcctagtgcagtacctggcaatacacataggtgcttagtgggtgcttgccgaattgttgaatggatttatttgatgaaatgtcaggagaatcaccagaaatgaaatgttcgtgtaatggacagggggaagtttgaggttgatttgaaaaaggagatggtagagacagtattatgggtcatgcttcagagtttatttgctttacaatacattggacagcaaccagtagattgttgtgtgtcattttaattccacatgctaatgtccaaatatgtcatatgtcttaattgttgcatacgtgggttactctgtaaaggggcaactgtagtatcacctcctcatgccacaccctgctccactgtagctgggctcgataaccttcaaatcaactcacagaattccaggacagacaagagcatctgaaaggttatctagccccagtcacctctgatgccttccagctgtctctaacacacctgtgggctgacttccagttcttagtcttcacggctccctatgatgaactgcccctgctttgagggattttcctccattgcctcagaagtactgccctgggggagcttctgatgctcttctgaccaccttgtctctgcctttttcactagtcctctgttcctgctctccaaattttgggacgttcctgagttcagatcttttctttataatctttcttttatattctccccatcagatggttcattcattcctcaatattaactaacatttccatattagaaataacttccttatctttagccctaaattttgtcccaaactctggacctacaattttttggaatgcttatgccttgcccagactaaaaccaaacttactgtcttccctctaaaatcagctccccatcttctatttctccctgccacccttcctcccccatggctccaatattgtcttgccagtctggtcttaaaaccacagtcaatcttgttgcttttctctttgtctcttgtgcatggctgatcagcagtcaattgttttgtcaattgtcttatatgtttcttcttcctcttccttgcttcctttttctgacctgaagttagggccttgttaccaaacatctagatgaatacagtgaccccctaattgagaggctgtctaccaattccacccaccctcaattctatactcaaaaaaaaaattagatgtaatctttttcagatactcctttggtattgtcacttagtttttgagtgactgccactatttcccgattggcagctctgcctggcattaagctcttgacattctcaacctaagtgtccagccaagttactctgttcattgtcccctcaacacgcctgtgcatttgcacctctgagactgcttctgagtcagctatgcactgccctttagaatagcttcaaccccaaatcctaccagtgcttcaaaggcccagttcaaatcctacccctctgggaagtctcccttcctttagtcaacttctagggcttttgcaattttatcacttgttttacatcagttttactatttttcatgtgtgagagttttaaccttccaattatggtacaatgtctttaagggcaagggccctttcttagaggaaaccctctatgaattctccaatgataaattattctatgaattctcacaactttctaatataaaggcttataaaaagtgggaactcactgtttattgcttaaaaaattgagatttaatttgaacttaaatgctctattaaattgagtagaatagcatcttaaggctactggtagtctatctatgccacagatggtttagagatcaaataattactcatatacctatgacagcagagtactggctgtaagatccccccaaaactcaaatacctattgggtttgtcaggcaacaaaaataagtgaatccagctaggtctaatacaatggaaaatggtaggacctggggcaaactctgcataacttgcccaaaggcattcaaattcagattatgttcagacattgctaattacaattagtgtcttagacacttggcttcaaaacagtggttagttcaggtatttcagatcaattgggtatgcatttatctaggtcttcatggatagccgggctctactagacactgggagagggaagaggcaaatgggataagactggcagtatttaacaaagaatgaagtattttacaaacatgatcctttaggctggttattgttacacaaaggaatgatttgctaggattcttgagatacttccatagaatgtctatgcctcacttattgcacagaccagagaattccataaaagcactggctgtgtcttatttacccttgtatactagagcttggcacatagtaaataccaagtaaatgttttgaataaaagaaagagataattaaagcttcagcaccacaattatttgtatttcatctatcagtttggaaatagatctccacagacagtagaaatggcaagaaactaggcctatagcaaccaagaagtgaaactgctagaacctaccatcatttctgatcctcttgcaaattttgcttgaaaaaaatttcctcattttctgtttacgaacttatcctcagaatttacagatgtttccttgatttctctggaaagatacaacttcctaatgcaattgagtaaattgatacttcttatgtagaaataagcagaataagctgggcaaggtagcccacaactatagtcccagctacttgggaggctggggcaggaggatcacttgaagccagagtttgcttgaggccaggaattcgaggctgcagtgctctatgatcacacctgtgaatagccactacactccaggctaggcaatgagtgagacctagtctctaaagaaaaaaaaaaaaaaaaaaaaaagacaaaataagatcaaaattgagtatgaactgataaatacaaggtagacaagaaatatcctgagaggcgcaatcgttctgcagacatttgcttgggaagctcaggggaggatttatgaaggaggtagccctgagtgagtcttaaaaaatgggtagacttttaccaggcaagatcttagtgaagttagtgagaggagtggtcatataggaattcatgggatttttagaccaaagattaccaccctcataagtgataatgacgatgaatgtgaagaatgtttaccacttgcaaagtatttttcacataccttgtccaagttcccacaagcatttctgttcactacctgtggtttggtcaagagacccagatattagagaacgtgttgatttctagtttctaactccgcccaataacattaagatgaaaatggatagccacataggaacagacatcaataaacatatttagaaaacacaagtgaattttaaaaggggagacttaagaggtggcatggttgtttgaacatgttcgtttttgtctcctggagaaaagtcagcacaatgctcattcagctacataagtgtttctgttacagctctttcagtccaccattcggcaggtcctgaattcttgtcccttgtccagaaaaaatgaggtatgtggacaactggagggtgagcaaggcggagaggagcttcgttgagtgacagaacagctttcaggagacccaaagtgggtagcacttttccataggcaggaaatgagtgttcaactctcagcagagaggagacccacaatggatagctccttaccacaggcaggtcatcccagagaggtgaggagacacaagccaggcacagtggctcacgcctgtaatcccagcactttgggaggccgaggcgggtggatcacgaggtcagagttcgagaccagcttggccaagatggtgaaactccatctctactaaaaatatgaaaaattagccaggtgcagttgtgcacgcctgttgtcccagttactcaggaggctgaggcaggagaatcacttgaacccgggaggcggaggatgcagtgagccaagatcacaccactgcactccagcctgggtgagagagcaagactccatctcaaaaaaaaaaaaaaaaaaaaaaaaaaagaaaagaaagaaagaaagaggagatctgaagtgagcaactgcttcccctagctggtagtcccaatgtctgttcaagtctggctgagtccagggttttgtgtttgtttgttttgtttttttgagacggagtctcactctgtcaccagggctggagtgcagtggcgcaatctcggctcactgcaacctctgcctcccgggttcaagcgattctcctgcttcagcctcccgagtagctggtattacagacacccaccactacatccagctaattttttgtatttttagtagagacggggtttcgccatgttggccaggctggtctcaaactcctgacctcgtgattttcctgcctcggcctcccaagtgctgggattacaggcatgagccactgagcccggtcgagtccagggtttttacaggctcagaagggaggaagagtgtgctgattggcccatgggcagccatggaagggcccagaaaaagcactgtaagttcttaccccaggctgtggactccacccacaattggcaacctggctcccaggctttgggccatccctggcttgaaggttgggtttcaccagggacctaacccctttccgccaaggaacctgtctccctcttgccatcaacatgctgtccatgatgcccaggctgttcgtgccgaggggtgcctgcaggcctgccctgagccaccctcagcccctgctcagcctccctctgtgcttgtcagcacccaacatctggaagaggtcgaggcagcagggggctagtgtgtcagtaccatcctgagcacccacatgcctggccgggttgtgacagcacctaggcttggccacaactttgcttcacccagtagcaggtgccaggagtgggaagaggccagggagtgggagcaggcactttcaaccttgtgggagcaggggacttcctgggcccctgagagtacagagatgcctgggtccagagccactgctgggcagctacaggggtgcctgggagcatgcggttcccaccccgccaactcagtacggggcgggactcccacctgttcttggcctccctggccacacctccactgctgcagctgctctaaacgggcagctgctgccatcactgtgagctatgattgtgccactgactccagcctgggcaacagaaagagacctatatggtatgttaaatggtaatgactgctttgggggagaaaagatgactaaggattgttgggaatgctggggtagggttggagtgctcttgcaattttacataagacagtctcaggagaaaaaacaatgaaagtgtccgggtagagggacatgtacactggcagcaaggtcttcccttagggattggatctgcggaagaggccacacaggcctggaagcaggcttaaggccattcaggctaggaattccagtgtttcaaagacagactgcaatggatggcggttggtaggtcaaaagctccagataacatctctcagccctgcgaacaccttactctcggggagaaggatgggcacagtgggtcctttaaagcatggggtccaggacaggggcctcttgtcttggctgttgaaaaaactgggttttacactgagtgaaatgctgagccatcggaaggttttaagaaaatatggtttgacttttattttttaaaaaccactctggctgcagaatcaactgcaggaaggcaaaactggaatcatagcatccagttgtcagactaatgcagaaatcaccatgagaaatgacaatgactctgaccgatatggaagcagtggaggtggtgagaaatggtcagattctggatatatttgaaggaagggccaatagggttggttaatgaatcagatgtagagtgagaaaagaaaggactcaagatgactccaaggttcttgtccttcacctcaataagtggaggatggagcagaggaaggcaagactagaaggtaaaaatagcagtgagaaggctctgctatggtataagaagaaatgataagaagctgaattaaggtgatggcagtggggtggaagaaaggagagccaccatgcaaaaagtatccaggagggagaattaacaggactaggggatgggccatatttgcaagatgagaaatgcagaggtctaagattctagcttaaggtgggtgttgctactattagcataataggaaaacaaggcacaaagacttttcaaaatttgtccaaggtgttagaggcttacaatttgtaaaaccaggattaaacccagatgtgtctgattttagagcctgagctcttactcattgcataaaccatattttccccagaggaggattagtaggaaaggaagctgctggttggaaagtatctttatagcagtgtctgttcctcggtttgctcaaggggacagtgtgccaggaaagtccccgtggaagggcaaggaagaaggggaagttaaagccagtggcaggtgatccaagaatcttttctgttgctagagctatgttacatgctgtcctttcatgctctaaaaataagagtgctggcaagtgccaggcctgttggtgcagcttaagatgatacctttcttggatatatatgcatctgaataaggaaggctatcttctggtcaagctaaggtatgccatgagcatttccctgtggaaagcacttaattctgttcccagttgttacctgctgtaagatctccctttctaaaataaaaacaagaatacagctcactgaggaccttacatttccctctagctactgactcatttctcttctcctttttatagcactcttcttgagagagttgcctatatttgttgccacatctttacccattctcttttgaacctattcaagctttcatctgtacaaaactcactgatactgtgcttgtcaggatcatccatgacctccatactgctaaatgcaactctcaagagtatttggctctactgatcactcctttgtagcactgtgttttaaaatataggttttattattatttaggtatggtgaggccaatatatcaggaaatgactgtcgttgaaaaaagtatgttgtactcacagatcccaagagaaggggggcacaccatgccacaaagggccacatggggaagcaccagggtcagccaggaggtgggtggggggtgcgcaagatctttattgtggtttcaacaggaagaaatgggtgaagcagggtgagtggatttaggattagctgatataaataatttcagcaggctctggggcataggggctgtccctagtcttctggtacttggccctggggtgattaaggcagttgcatagtgttgggaatgtgaaagcccccaataaatgaggcagttgtgggtatgggctctgaaatgggttggtttgcatttgaaaggtgtgctcatgggcaagtggtttactctctcttagaggttagaattggctaaccctgggagcggcagtcccttcagggtcagcaaggccccaggtgtcaaagcatcagaatacagaaaataaaatgcatggataatacacactgccatttgcctttgtacccttcctttcaatcttctctgctggtgaccgctcttcacaaagatctataaatgttggaataccccatgtctcagtccttgggcactctctttcctatctctctgtaggtgatgtaatgcagatatccatgactttaaatctttaacacttctgcattgatgactcctaaatttacatctctaccccaactgcctactaaacacctccacttggctatctaataggcatttcaaaccaaatctacaacaaacgtaactctttttccccttccttaatttgcttctcccccagccttctccattttaataaacagcatctccattgccttagtgactcaagccccaaacttaggaattttcccagatttccctctttttctcaaactatatatctagcctgtcagcagttcccttcaggtcttttttcaaactatagaaggcctaaacaaaggaaagacatgctgtattcatgaattggaagactaaatattattcagctggctgtattccccaaattgatctatggattcaatgcaatccctaccaaaattccagcttcctttgtctgcagaaatgagcaagttgaccctaaaattcatttgaaaatgtaaggaagcccgaatagccccctaaaaaaaaatcttgaaaaagactaacaaagttggaggactcacactttccagtttcaaaacttactacaaagctacagtaatcaacgctgtgtggtactgacataggatagacatatagttcaataaaacagaatcgagagtccagaaatacatccttatatatatgatcaattgatgttttgcaagggtgccaagacagttcaatagggaaagaataatttcctcaacaaattgtacaggcacaactgaatgcccacaatcagtagaacaaatttggaactaaagttcttatatttaggttcttgatccattttgtttaatttttgtatatggtatgaggtaaggctccaaatttgttcttttgcatgtggacatccagttgtccctgtacaattgctccatttatatttatcttagcagaaaatacagatgtaaatctttgtgaccttgactaggcaatggtttcttaggtattacacctaaagcacaaacaataaaagaaaaaagtagataaattggatttttttacttaaaatcaatttgtgtttcaaaattaaataaaatcaaaattaaattaaaacatttatccttcacaggattctataaagaaactgaaaagacaatgtgcagaatgggaaaaaatatttccaaatcatatatttgataaatagtttggcaattcctcaaaaagttaaatatagagttaccatttaattcagcaattctactcctacatatgtacccaagataattaaaagtatacatagacaaagacttgtatatgagttttcataggaactttattcataatagccaacaagcagaaacaatccaaatgaccatcaactgatgaatgggtaagcaaaatgtggtatatcatacaatggaatattatttagtcacaaaaaggaacgcagtgctgatatatgctacaatacagatgaaccttgacaacattatgttcggtgaaaaaagccagccacaaaagtccacatattgcttgattccatttttatgaaatatccagaataagcaattgatagagacagaaactagattagtggttgccaagggccatagggaaagggaaggggaaataggaagtttctgctaatgggtaaggggttccttttcagggtaatgaaaatgttctaaaattggataatagtgtttgttgcacaactccgtgaacatactaaaaaccacagagtcgtgcacttaaaaaaagtttgtgttttaaatatatatacacacttagacacatataaccctctttcgtatatcaattatactttaataaagctgttgaaatttttaaaataaaattttaaaacaaagaaaaaatatataaactcgccaacagaccacttctcacccctactagcccctctactctaagctatcagcatttctgcaaacacattcctaaccgatctcactgcttgtaatcttgccagcaacctctccctctcagcaatagtctattgcctacaccaaagcttagttgtctcttaatgatgtaaatgaggttctatcattctcctgacccaaaccctccactgcttttcatcacactcagagcagctctgctgttgcctgatttagatgtatggctccaacagatttcccctgaagaaatgattccatggctgataaaagttggaaagcctcctcagtttcagaccattatcagattagctgtgtgctctgtccctttcctcaaccataagaagtccatggataaagaaagcttcagagtaaaggagaaagcatgggaggtacagcaggaccaaggtggggcattcgcagcccccaccctcatcagagccagttccctactctccctgtctaaacctcttagtaagaggtagttcaagagaggggcaaactcaattccagcactcaaaagcacttgactactttgctcagtcaactagcaagtatttattgagaatgtagctctgttctatggagtcttattttcaagtgtcagactcccagacatccagtccaggtaaagaagatggtgtccattattcatttgacaaacaaagttggggttcaagggccagctattgaaaaaagctatggaaagcttcatgagacgtgcaggtaactgccaatatgtgtggttcacaaggactggttcatattcagaaacggccattagaaaaggaagaagaacttctcatttggatttataaagagtgtcttgtttactcttaatttatatcttctcttctccaggaaatcaacctataacttctcctcccagctccactctaccatggtctgtcaccttccccaaatgatttgttattcccctgttttcaaaagtgaacaaagaaccaaagacccagcaaagtttcacaaggccctgagactttcaattgtctatttcagatcaaatacagaacatgatcttcctcctgctaatgttgagcctggaattgcagcttcaccagatagcaggtaagaaaggacaaagggagaggcttaagaaagaagagcaggtggtggttcctagccaaagccaaaaatgagaatgtggccctcaggctgagggctttctttgagaggacgtatgatttctgggctattccaagcaccacaaaaaaaaaaagagtccccatggtggcttatacatgccaatgtccctatctgacagaaacggtgactgagaatattgctccatctattcccactatccagtgagggtaatgacaagaagacaggatcactcagaccatgtaaatctaaactgatacaagagggcaggggttgagttcccttaaaggtgagatgccaagcagctgtccccttcctttctggcagggagagtaaggagacaatggccagggaacaccgttactctaaagataatgtcttgaagacattctgcatattattagttgtttctgtgagtttcttttttgaaaagcaacaatagcagccgttggtcattcataccttaatgtggtttactgagtcttcctaaaacccaaatgaacaatgaaccttaaggctatccctttggacttgaagaaaggacttctattggaggatgagggtgagcagaaagaaaagcagtttcacagttggttgttctcctggggaaggtagttcagaccattcgagggtgtagttagaaccatgagtgcactattttggatgaacaccaggagctaagagagtaacatagaggtgtggacagaggattaagtcctcaagacaatagccccagccccatgggaaatcatctttctgctcatgattgagaaataatggctcccttggcacttgataacctttc

SEQ ID NO: 85 - DNA, 11846 bp, Homo sapiens
  2nd Promoter of PDCD1LG2
aaactaaactttttaaaatataagtttgaggggaaaatgaactaagttagtaatgttttgggaataagatcatgggttggccacaccaagcaggtaatggcacaaggataagataattaacatttattaagcacttattacatgccagcaggccctgttctaagcactttccgtgtatcaactcatttcatttgcacaactccacaaagcaagtcttttatggtgcccattttacagataatgaaatgaaacaggcaccaagagaggaagccgtttgtttgaagtcttacggctggcaggaggtgaaacagagatttagacagaggtctgcttccaaaatctctgagcgtgacccctgtgctcccctgcatagggctggctttcctgcaggggaggagggaaggtgctgaggtcagaggaggagagaggaatgatggagggagtggagagggcagaggtggctgctgacgatggggaacaagacactgtcctcttccccctgcagttcctgaaggatcttcattctcccactggccacctgtttacctaacccctctaaagcctcagtttcctcttttgtaaagtgagggagccttctcaggccattcaccttaattagttcctctctatgccatataaagtcctagaagccagttctgctgtggcacatatgcagccaccaccatcatcaccagcatcccacttccggctgagagacgcaggccccggtgtctcccagtgtgcaagttgtcagagcaggctggaagagaattgggcattctctgtctctgctgtagaatgaccaccctgaaggataattctgctcacttgttattctcctcactggacaggagaccctggaagcagagacaatatctgatgcacctctgcattcccactacctggaacataaagtcgttcaataaataaacatcctctgttgaatgaataactggaaagtacagccatgtggccttatgattccagagtaacaagtaggaaaagcaacacttgcatattaatttctttattttttgtttctgttttctaccttatctggcacagagttcagagtaggtacagtcattaaagaagtcactgatttttaacatgccacttaagcaaaaggagcaagaaggccctatttatgttgatcaactaattcaagaaattctgggcttttgttttttcttttcttttttctttttctttttctttttttttttttttttttttgagacagggtttcactcctgttgcccaggctggagtgcaatggtgcgatcttggctcactgcagcctaccaggctcaagaaattctcctgcctcagcctgccgagtagctggggctacaggcacatgccactgcacccagctaatttttgtattttttgtagagatagggtttcaccatgctgcccaggctggtcttgaattcctgagctcaaatgatctacccaccttggccatccaaagtgctgggattacaggtgtgagccaccacacccagccaaattctaggctttctatgtaaattataaaatgtaatttacaaaactctgttcagacattttatcaccaaggcagagagtggtcaaatcacagagctagtaaggagtagaaccaaatccagcttctctgcccttggtgtcaactgctttttctactttccacatagctccacccctccagccagtcacaatggtttctaaaagtggacctgcctttgcagttattcattcaacagaggatgtttatttattgagcaactttatgtttcaggtagtgggaatgcagaggtgcaccagatattgtctctgcttccagggtctcctgtccagtgaggagaacaacaagtgagcagaattatccctcaaggtggtctttctaagcagagacctgccttaattctgttgccttaggtgagatcaacttacttctgcatgcttccatttctcctcccccttggtagattgagaatcatggtatcagctcttcttagtgaaagaaaatctaagaaacatagacaggtgtccacatcttgaagtagctgaagtttgtctttgggttctcagcttccttttctccctcttgcttacttcccttcaaggattgctgccatcagtgtcatcaaacccagggattccctaatgctaatccaccaattagagcacggctggttactacagaaccactgatgagtttcaaaaaatgcagacttctggaccccacccttggagattttgaatcaggaggtcttaggtagtgcccaggcacctctatgtttcaggttccccaggggattctaacctgcagccatattggggaaccactgacctaacacgaaaacatgagtcagctgtctcaactgtattgaaagtgatgaatcatcatttcactttaaaaagaaaaaaatatgagctgaaaccaaagtcattgtgagaacctttcatttcctttacctgagtttgaattcaggtttcctttacttgagtttgagtttagaagtcttctatacttggtccaagcatttttacggagattcccaaggtcttaaggcaaacagacttaagacctgtcctcagtttagtcctgggaacatgctgtaaccctgatcagccctggctagggggaccctgggaaactggctggctctggagatccttcaggccagagttgctgggaaccacaccgggttcatcttacaccatgcctaggtgctggggtccaatagtcttgtctcctctggcttcccagagccagaactaggaagacgagaaggctttgggatatggctggcttccagagactgaatcagcaactcatattctcaagaccgaggtgggtaggcctgacacagaagggtcaggaggctgctagaatctatgacagggcaggaacagcgctgaggcagcagaaactgagaaagcagaagtcaccagaaagagaaaagaagttcaaagtagagggaaagactgaggaaataagcagggtgagtcgaacagatgagatgtgcagagagaagcagatatgagctgagggagagagactcaatgaaccacgagaggtgggcaaagaaagcagccagtcctgaggttaccttgtttctgacagtttgggtcctgcccatcctttcttttttttttttttttttaagtgattgattgttggttgtttttttttattattattatactttaagctctagggtacatgtgcacaacgtgcaggtttgttacatatgtatacatgtgccatattggtgtgctgcacccattaactcatcattaaacattaggtatatctcctcatgctatccctcccccctgtccccaccccacaacaggccccagtgtgtgatgttccccttcatgtgtccatgtgttctcattgttcagttcccacctatgagcgagaacatgcagtgtttggttttttgtccttgcaatagtttgctgagaattatggtttccagcttcatccatgtccctacaaaggacatgcactcatccttttttatggctgcatagtagtccatggtgtatatgtgccacattttcttaatctagtctatcattgttggacatttgggttggttccaagtctttgctattgtaaatagtgccatgataaacgtacgtgtgcatgtgtctttatagtagcaagatttataatcctttgggtatatacccagtaatgggatggctgggtcaaatggtatttctagttctagatccttaaggaataaccacactgccttccacaatgcttgaactagtttacagtcccaacaaaagtgtaaaagtgttcctatttctccacatcctctccagcacctgttgtttcctgactttttaatgatcgccattctaactggtgtgagatgatatctcattatggttttgatttgaatttctctgatggccagtgatgatgagcattttttcatgtgtcttttggctgcataaatgtcttcttttaagaagtgtctgttcatatccttcacccactttttgatggggttgtttttttcttgtaaatttgtttgagttcattgtagattctggatattagccatttgtcagatgggtagattgcaaaaatgttctcccattctgtagcttgcctgttcactctgatggtagtttcttttgctgtgcagaagctctttagttttattagatcccatttgtcaattttggcttctgttgccattgcgtttggtgttttagacatgaagtccttgcccatgcctatgtcctgaatggtattgcctaggttttcttctagggtttttatggttttaggtctaacatttaagtctttcatccatcttgaattaatttttgtaaaaggtgtaaggaagggatccagtttcagccttctacatatggctagccagttttcccagcaccatttattaaatagggaatcctttccccatttcttgttcttgtcaggtttgtcaaagatcagatagttgtagataggctgcattatttctgagggctgcccatccttatatcaccaattcaattgaggagactcgaccaaatgttttatttttctaataactgttgccagtagtattctgggaaatccttctagcctgttgggcagtgagtgaccctcatcatatatcagtgcaatttcatgatttgtagatcacttattatgactcagtctagtcccatgttttctaatagcttttgagatctaattcatataccatgcaattcactcatttagagcaggggttcccaaaccctggactgtgaaccagtacccatccatggcctgttaggaactgggctgcacagcaggaggtgagcacccagcaaatgagcattaccacctgagctctacctcctgtcagatcagtggcagcattagattctcatagcagtgcaaatcctgttgtaaactgagcatgcaatggatctacgttgcttttcttatgagaatctaactaatgcctgatgatgtgaggtggaacagtttcatcccaaaaccatttccaccacccttcccacaatgcacggaaaaattgtctacgacgaaactggtccctggtgccaaaaaggttggggattgctgatttagagcatacctttcagtggtttttagtatatgcacagagttctgcaaccaacaatataattaattttgaaatattttcatcatcccaaaatgaaatcccatccctctagcagtcaccccctagttcccctcattcctcccagtcttaagtaattatttcctgtctctatggatttgcctattctggacatttcgtctaaatggaatcatacaatatatacaatcttttgtgacaggcttctttcacatagcataatgttttcaaggttcacacacactgtatcacgtatcaggactgcattcatttctaaagctgagatatattccattgtatggacatactgttttttattgtctcattcatcagtctctggacatctggtttgtttccaattttttgatactaagaataatgcttctatgaacattcatgcagacatttttgtgtgtacatttcatttcttttgaaatatacctaggagtagaacactgggtcgctatgtttaacattttgaggaagtgacagagttcatctcatttaaaattccaatcccatattttacaaatatgagatattttacaaatatctctcctcccagaataggtgaaacttatgaccctgcaatcttcaagttgggcagagaaatggctcaggtctcaggcggttgcagtctaagggtagtggcctgtgataatggctggggcctcccatgcctttggcttccttctcttctgcatcacacgaagccatagtaactgttggggtttttggtcatccttgaggactcaggagcctgggatgtgaatgatatccccattttcttcattcctgaaaataagtctacagcccttttcactccccgggtgtgggacacccagtgaacctcccattttcagaaacttcaggcaagaagcaggtattaatctctatacaaggcactctcaaactttggagatatgcgtttagcaccccttttctctccccaagaatgagaggagactcagataatatacatccactctaggctctcggaaccttctccctgtctcttagtctccttcttacttgtctttgttcaaggccagtgggccagtttaatttctctcctcctcctctcttctctcctctcatttcctgcccccaaccctgcacttgaaagactcattgaaggaattaggcctgactttattttttttaccatattaacaaaacgatatttctttttgaaaaatttatttttattatttttaaagacagagtcttgctctgtcaccctggctggagtgcagtggtggaatcatagttcactgcaacctcaaactcctggactaaaatgatcctccctcctcagcctttcaagtagctgggactataggtgtgtgccaccactcctggctttttaattatttttttaattgacacataaataattatatagatttatggagtagagtgtgctatttcgacacatgtctaagatgtattataattaaatcatagtaattagcatatccatcatctgaaacttttatttctttgtgttggaaacactcaaaatcctctcttctagctatttgaaaatatagaatacattgttgttaactgtagtcaccctacagtgctatagaggccttacttaaatttgacctttgtgagttcagtaacttttcctcaacaagaagccatctacccagttatttcttcactattcagtaacatggggcagaaaaaaatacttaatcagtgccccacatcaatctgttacacttataataaatctctttttattttgaaaagttcttttctgtgaatgagccaaacctagacctctctccttctaagaacaaacaagtatttcagttgctccggccagaacttcaattcacacctttccttctcttactttgagaccaggcctttcttagcacatagagaccaggtgggactgcaagccaagtgtggactttgaggatgatgaccagtgactcacctccagcccctggctgaccatgacacaagggaggccaattttcgggctggcccccatgtggtctccctcctcctcctctcttcccccagctgctcatgacctgcctgccccaccccagaaattccttgtccccattttctttttcatttgagacagagtcttgctctgttgcccaggctggagtgcagtggcacgatctcagctcactgcaacctccgcctcctgggttcaagcaattctcctgcctcagcctcccaagtagctgggattacaggtacctgccaccatgcctggctaagttttgtattttttagtagggatggggtttcatcatgttggccaggctgatctcgaactcctgacctcaggtgatctgcctgcctcggcctcccaaattgctgggatttcaggcgtgagccaccgtgcccggccccctctccccattttcaagagattaagctggtcttcacctgcttccttcacattccagataaactcacagcagatccctgcttcctgactttggaaacgttgctaaagcaggttctagataaactgctgcctcctcatttctcacaccttccttagctcttgctctttgcctgttttcccaaaattcaagtgcatttctttctcatcctcaagctgtatttttttcccttataaaaccaagcagagtgggaaatactggacttatttttttggacctgaaagcattaacattgatttagcacctgctgtatgacaagcactgttctaggtgatttacatgaatatttacatcatgtcatattacaatatattacattacatcgcatcacatcacatacattgtattgcatcatattatattacattgaactacatttgcattacactgcatttggaggaaaatatcttgggaggaaaggacagaaatggttgtagcatttcttacctactctgccctacattcacagggtgatcttggttaagctctgtaatctctctttgtattaactttcccttctataagataggaggggcctcatagattggctggtgacataattattaaactcattatattcttattatagtctaatagtttatgaccaaaattctaattttctatttccaagtgacaatgcaatgttgaagggggtgcctaattctacacacagacacacacacacaatttagctatgcctctcaggaatcttctattaaaaagagaacaaagctaaattaaataaattgccagccaggcatggtggctgacacccgtaatcccaacaatttgggaggctgaggtggatggatcacttgagctcaggagtacaagactgttaggttttgaagggaaggcgagacttaaagaaagacacacacacataagagggaagttcaacaacaaatgcagactttatatccagcataaaacctacagaagtcagagaccagtctaatgccagtacctgctgctgcttataggctggggcaatttataggtatgggcaggaggggtctgggcagtatggcttgctgcctggcaggaaattgataagatggtcccatgatgaggcagttctggtccttgttcaggcaggatgtcatcatggtgttccttggacctttgcccagaaggtctttgccttctagtttagcataaaaaggaagaggggcattgttaattatctggctgtttcctgctaaataggagcactgcactcaggctttgggttttcagcagtgggtgtccgactttagagttgttttcctggaagtgctgataccaaacttggcagagaagaatggtatcgtgtttctatatagctgcctggacaagggagttcggcctttgggagataaagcgggatatgaaggtgcgcacacatgggccaattgtcagtattatgagggagaaaattagggaccctaagacaggggttacccaaggtatccactttaggaaggatgacccctgccaacagtgaatgacttgatgttggatttctgcagccgtgtaatggagcctgtgggctgcgttgcgaacaatgccggcttcattaacataaaaacagcattcttcttggacatatacacatgtgccccaagacaagaatgttaatccaaactgcaccattttgtaagcgccctgctattttgcagaccttggtaaaagtgacacatttcatgggtttttgggccatgagaaacaccctgcctaaccacttgaccacaaggcccacaaaggcccaactaaagaaatatctctatcatatccttctgggcaaaggtccaaggaacaccacgatgacatcccgcctgaacaaggaccagaactgcctcatgacgggaacatcttatcaatatcctaccgggcagcaagccatactgcccagacccctcccgcccatacctataaattaccccagcctgtaagcagcggtaggcactggcgttaggctggtccccgacttctacagtgtgcatatttctttaaccctcgccttcccttcaaaacctaacagggatcagcctgggcaatatggcaaaatgccatctctgcaaaaaaatacgaaaattagctgggtgtggtggcgcatggctgtggttccagctacttgagaggctgaagtggtaggatcgcttgagccccgcaggttgaagttgcaggcagccctgattatgccactgcactccagcctgagtgacagagtcagaccctgtctcaaataaataaataaataaaaataaattagaaacacatacagccctttgttgatttctttaaatgttttcttcttgttatttttcagtaatctaactatactctccattattgcttttaaaaaattatttctgtctttacaaaagtaatttgtgctcatggcagactatttaaaaaacaaaatgaagccaaagaaagaaaataaaaattaactgcaggagaaggaggcaagagagctaactagatgcagccaggagaaacacctctcacagagatcttcccagattttcagagggaaggcatcaagagtggacagagggaagacacagaggctgggctgaagcaggaggaagctgaaaaccctgcatgaggctaccacacactgggacttgttcctggcccccaacaactcctgcagaagggatgagttgaacaggcaaggagaaacatgctcttgcaatgggtctctggaatcacgacaggaagagacccctcaaccactgtggacacttgagttggcaaggagagctgcttagagaagtggtaggggcagagctccaggtgatgtggagcccagtaggtttcgtgcgggagtgtttgtggtggagtacagccagcgatgtccatctccctaggctcaacttgcttccataggagactttagcaccaggggagctgtcggtcctaaattctgcagggcggtgttgcccatgagatagggccagtctgacttcagcaccctttggtctgctagcctttcccagggccccagcctgtccatgcctgcttgcagtgcagccaccaggtacctcctgggagcccacatcatagcacctgtgctggcagaccatgccagactgtcagagtgctgcagcagagtagcccccatggacacacaccagcccacccagctcatcccctaactacagcctcccccttgttgctttgcttgcacacacttgcccacagccacccttcatatcactttgccagtacctgcgtgtacaggcagacctcaccttcccttccccaccagcatacgtgtgagcgtgtgccctgccatgccactgctgctggtgtgagtatatcctgcccctcctttccctgcagcactgtccactgtgatggcaatggcattgtcatcagagtgttgttgggcatggagctgccagctccgccccagccagtccccagccctgcccctatgcgaacactgcctatggcacaaaactaggcacaaaaaccagcaggcccacccctgccctgagcggccaatgcctcccatgtgaatgtgcacagggggcacacacagccctgcatctagcagcatcctgctcccatgctaatcccaacactggcacaaacatgtgtacagttgctggtgagggccccccaacctgcctgagccatgctgccactgctgcttctatgaacacctgcacgaaggctggcactccggcatccactagcaccttgctgcagccaacaagtgtgcaccccactgcaccgctgctgccactgcgactggcacatgcgactgaggatggatcatgtttccacagccctacaaagcactttggctggcaccatgcctcagagagttgtgatcagaggtccaggagcacctcaggcccctccaacatagcaggttcctaaccttaaggagccagagaacaagaccggggcctgataccagtgccccagagttataacacacagtttgggagtcctgagctgagacttgggcccctaaaatcttccagaaatgaagccagtctactgaacccaccttataccacaatcaaaccccgaaggtcattaaatatgatataaaaagggggaaaaaaaaacaaaaacagcaacatcaaagattgaaggaacatcattctacaaagatgagaaagaaccaagataagaactctaacaactaaaaagccagatggtcttctttcctccaaacaatcacactagttctccaataatggttcttaaccaggctgagatagctgaaatgacagaagtagaattcagaatattgata

SEQ ID NO: 86 - DNA, 6102 bp, Homo sapiens
  3rd Promoter of PDCD1LG2
taggtgtgtagaagtggttctaacttgcattttcctaatgactaatgatattaagtatacatatatttatatattattttataatcttatatataatatacatattttatatattatatatatattttatatatatatacacacacacacacatatttttttctttttttgagacagggtatcactctgttgcccagattggaatacagtggtataatcatagctcactgcagcctcgatctctcaggctcaagcgattctcccacctcagactctgtagtaactgggactacaggccatgccaccatgcctggctaattttttttttttaattttgtagacatggggtctccttgtgtttcccaggccagtctcaaactcctggactcaagccatcttctcgcctcagcctcccaaaatgctgggattacaggcataagccactgcacctggccttagttaagtttttatgtacttattgtatatcttcattggtgacattcaaatcatttcatcctttgtaattgtatactaaggaattaaacgattgtttaattattgtttattttcttattgtaaggttttaaaaattctctatttttttgagacgcagtctccatcagtcgcccaggctggagttcactgtcgtggctcactacagcctctgcctcccaagtttaagcgattctccagcctcagcctcttgactggctggaattacaggcatgtaccaccatgcttggcttatgtttgtattttcagtagagtcggggtttcactatgttggccaggctgtctcaagcttctgacctcaagtggcccacccaccttggcctcccaaagtgctgggattacaggtgtgagccactgccacgaccttaagagttctttattctagatacaagttctttatcagatattgattttcaaatattcttttgaagtctgtagcttgtcttttcattttcttaactgtgtcttttgcagagcaaagattttaattttgatgaagtttgatttatcaatgttttcttttatggatcatgcttttggtatcatatccaaaaactctttacataacccaagatgtaaaagattgtcttctatattttcttctacacattttgtagttgtatattctatatgtaaggtttataatccattttaatttttatataaggtgtgatgtataggttaagctcattttagttttacatgtagatgttcagttgttccagccccatttgttaaaaaacacccatcctttccccattcaatagcctttgaatcttcatcaaaatcaattagtcatatttatgtgggtctatttctggactttttgttccattaacttatgtgtatatccttttgcaaatatcacacttatatttgttttttttcttacatttttatttcaaaatctaaggacatcttataacccagaaatattttttataccttgtcatgtcttagaggaaagagccaccccagtcttttttcattgatgtttttcttctctcttcgtactccagaggtagatgaaaaccagagggccacaatgaccatggtgatgcctgaggtcattctggggcacagacctcagcctaggttactccacttcgcctatctttagatccaaaactaccctgctgactgctgagataaacaaaggagaataatcaggttggggaaaggatttctatgcgaagacatgtctccatgcagtcctcctacactgagcagagcatgagtcaggtgcttagagcaggattttgtcctaaaccaggaacttcagagttttctgaagaatgtggctatgtaaagcacccccccaccccacccttacttctcaagtacattacgtggcaagtctgaaaaaacttacacttctgttgttaaatgtgggggataaaatataaacttagtttcaagaggaagctatcttgggaggtaatgcaaataattcgttgtgtgtttcctgaataagtgacaggtgctgactaccattgatgcttcattgcaataaaatgcaaagctcccccaagaatttttgaaatgcatcaagctaggtgttctaatctagcaaaaggacctgcatacatgaatttttcatgcttttgccaagtcttttgccctttagtttagttaagggccccacatgaatggaaagcctgtgttgtcagcttaattttgtagttgtggaaaccttccagttttctcctttgtctaataccttcaggagttcaatcctaggttgaagcttaatttaataaccatgtggcatgtaaagtagaaaacaaaacatcttttccttagcatacagcaaaaaaaaaaaaaaaactcactcatggatgtagtgtacacatgccagtggatatatagtcataactgcagtcattggtagcacagaaataaatgtgcattgaagacacagagatgaatttgaattccggttccatgagctaccattctttgaccttgggcaagttgcatcacttctttgagcctcagtttccccatctgtaaaatgtggatagcaacatctacctcgcagagttgctgggaggatcagatgaaatgatgggctagcccagtgtctgacttactgtgtttaagaaatatcaactattacgctacttcccagtgacagtccaaatgcagaccagtgttataactctacttctcaaacattaatgtgcatgcaaatcaccgtgaccttcttaaaatgcagatcctgattccctaggtctggggaaggcttgaaattctacatttctacctagcttccaggtgaagttgaggacaacactttgaaggcaaggtggtaaaagacgcttgcacgtgcaaatgttactttgtgtaactaatggttcgcaatactgtctgcactttagaagctcccaggaaaagaaaatctttaatgatgctgacctcatctccaaaataatgtaattttaacagatccaaagtagtgcctgggcattagtgtgttttaaaagcctcccaggtgattccaatgttagccaagattgaggccctctgcttagtgaatctaatttgcagctgggcttgagaaaaaacctcttcatagaattgtttgcatcagtgtcttgattgcctctgtaacttacaataagcaagaatgtttcaggatttcaaaaatctattgcattgcctaaacctcttattttgtatggagtaatcaagctcaaagtttgcatgtcttagaaactttacttggggcaaaattagaccaagtaacaattaatcttctaggtattctgagctattcagacatatgattcatgtttgctaattgctcttttctcttgtaaatattagctgaaaaatgtcacctgtctgacaagtagcatattttatgcctatcactcctggcacgcattcttacaaggcagacaggaaaaataggaagaaaatggacttttatcaaaggcccaggcagtaaagaggggagttctgctgtaagctaaggggagttccagaggaagttataggcgttccctttcttatgacaagaaagcatagtgcagtaaataaatttgctaaatagattcaacagtctctacccaaagtcatctatttaattcttgttgttatgcagactcagcaactaaccttccttgtaagccccattttcttccctgtttcctgtttatcaaatgtaattaaacaagagaagtattatagaagagtaaaagtagtaggtaattcttgaacttggcatatgattactacatatttgatgaatagttgaatattattcttcaaggacagattggatttggtatcaggtggctctgcattaagttataagggacttaataactcaagtatttaaggacggcttccatcataaagggatctgcccttaagagggtcccattatggagattctgaggtgagagctattccaagtgtgcagtggattaaaataaaagaatcatacaggaaatctctttttacatgccttattccagggtctttgcaacctggcacagcaagtgcagatatgattagcattgttttacacatgtacactcaccttatagccctgcccctgtgcccctcctgcacaaaagaatgctgggcacacgtgaactcctctctgtagaaaggcacattaatgttctagccatggttaaaacagggatagaggcaagccaaaaatgtcggtcatttgaaataaatctcaagtttgtgcatatcactatcaagtgtgctgtgtggcaattaagaatgccaatttgtgtgatcacaggcaagttgcagtttgatgaaaggaaagcagaggtgaatatataaccagggtcatcctttctttctccctctctctctttctgtcatttatttgccaagctcttaactagaacttgctatgtgctaggtactggatatatcaaagcaaactcagcctggtctttgccttcaaagatttgcaggatagtgggaagaaaaacttgaatcagaggacatctgcagtgggaatcattcaagcagcagaaaacccaaaagttacttatactgtgaaatctgatcagagaatggactgtcctggttagtaaaatatcctggaggataaagattggccatgcattccacatatgaattaccactttcccaagaattaaaacatggtacgaaagaaaggaacgaacatttgctgagtgcctactgcctgccagatctaggcacttcacatgtaacacctcgtccagcctccaccacaatactgagaggtagagttcaacctcattttatagataaagaggctgaagctcataaagattaaaggacggactcacagtcaaaggactcctaatcctgagtcagcatttgaacccaggctcacctgtcactatatcctatgctcttccgtatcacattttatactgaaacaacttctggaatagctaatgcttagaagcagctcccaaatatttgttgaatgaatgatttgattgaatgaatgaataaatgaatgaagcaagctctactgaacataatttgatctaatcttctgtgattattcagaaactacttcaagattttcctatacctccatcataatgaatacccattcattaatgatggaagcagcctaattttgtcatttttcacactttattgatgtaacactacctttactagtttggccactccttatgctttttttatagaactatttagatcaattcaacttttaaaaaataaagccacatacccctgtggtagatgaaaaacaagtatcatttgcactggtaaatagagaataggaagaaaaataaatgcagtgaaaataaagcagtgttatcaaatcctacccagatactgttatctacccggaagcttcctgtttgattaaaaggaaaaatagccagtgttagaggtgtggaagtctagttgaaattatatgcaattgaaggattaaaatagaattgaaaagggaataaattcctctctgaataatttaactccctttaggctttgattctgcctcatctaaaatcatcttacatacttctagtggcgtgtccctcacattttggtaaactctgagtggaaactacggattttgtagtcaaacatctgactggctctggattttaactttactaacatatgtcctgaagtgaactgcttggagccagtttcctcaactatataaccataatgacaaaacaggtttcacggtcatgttttcagtattaaacaatatagttaaaagtacctagcacagtgcctggcatagaacatactagatatacattaagtatcagttccatttttcctttccctttattgtcagaaaatagaaagcatctacagtgggcttgtatgatgtggtggttagaaatacctgatctgattctggctgtgcaatcttgggcaagttacttaacctttttgtgcctcatttttgttttctgaaaaaaaggatagaatattattacctaccttgctggcttctgggaagaagctcagtgagacgatgtgttagcagagtgtctgacaattgtaagaattcaacaagtaatagttattattaccatcactggtgagaggaagtgatacctggcacaa

SEQ ID NO: 87 - DNA, 23521 bp, Homo sapiens
  4th Promoter of PDCD1LG2
agttaacatatcacatcaccaagttgtttttttgtggtctttatttttttctcttcttaatctcaaaacagagaatgtaaaaaattcatgcttttagcaaatttgaatacagaatgcattaactgtggtcatcacacatggcaatagatcactaaaacatttcctctactctgagactgagcaacatcttccacatccccagcctctgataaccacctttctactctgtttctatgggatctacttttttagatttcacaaataaatgagatcatacattatctgtctttttgtgcctggcttacttaacttagcataatacccttcagttccatccatgttgtcatgaatgacagattttacttctttctaagggctgtaagtattccattgtgtatatataccacattttctttattcattctctgttgatggacatttagtttggttccacatcttggttattgtgaatcatgctgaaatgaataaaggaatacagatatctcttcaacatactaaattcaattcctttggatatatacccagaagtaggactgctggatcatgtggtcattctatttttagttttttgaggacctctatactattttccaaaatgactatacttagatctcagctttcttgaggcagggagccatatctgtttaattcactcagcatatactgcaaagaagcaggtgtgtgtatgaactgtgtgtgtttgtgtgtatgtatctgcatgtgttagggagaagtgcagaataaatatacccaactctttactatgtatagacattatctaggtctttattttttttctcttcttaatctcaaagaaaacagaggaaaggaggaagtaaaaagtaaatttttgcctgaagatgtttggaaaaaataccaaataaagtgagatagtgggtaatctagtgatttttatttttccgtcctctttctggcctccaattgtgaaataatttatagcactgtaagaaagaagccacaaattgtggtagcttggaccactgttgaggtctggaatcagaattccaatgttcaaatattggtcctaccagttataagctctatgactatgaacaaaacactcaacttctctatcttcagtaaccgtccacaagaattgggaatatcaacaatgccatctttattgcattgtaagaattaaataattcaatatatgtggaaaatagcatgatatcagggatatacaatgtgtttacaaatgataaccattattacttaatattgatagtgataattttattcatttcacatggcatgaagtaccaagctctataggaatcagaaaataaagtcttatttctttttcttctctattgtccagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtaagagctgcccccacttcctaggtctatcagttagggttcagacaagaaacagatggcatactcgagtgatttgaggagagtgtaataaagggactgtttacaaaggtgtgatcaccatttggagaaactacaaaggatagtgcagaacactggggcttcaatgttgggagggcaattaccactgttggagaagttactggaatcagaagggagctgtagggaaagccccacttcccaggagctgtagccacagaatagggaagctgccacatgcagcgactccaaagggtggaaactggatgaatgaataccccaactcattctcctcccaccctccaatctcctgctagcacctcccattggctgaacccagctagaagtcagagaatacaagggtccactgttgtattccataaaagtcaacttctcagggctcagagcaatattgacatgtacagaatagatctggagaggaaacagaaaatatctagtacaatagctaatcactgtgattcatgcacagtgtcatgagccagcaggatgaatattcctttgctgtacttgctgccagtcagctggttatgggtttttccaagaaatttggtctctaacaaaattcttcagagcctttactgactatgctggatatttttggaagggatcccatacttttgaacttcatacagcagaatttcaaacaatcttgggaaaataacaacttttatctgcccagtaaggacaactaacacctagtatcataatcatttcgtaagagacaggtaatttcatcaccgagtgcatatgttttctaatgctcttatatcaaattaccacaagcttcacagtttaagacaacacagatttattatctgatacttatggaggtcagaaagccagacttgagtttcactgggctcaaatcaaggtgtcagcaggattgcagaggccctaagggaagattccactttcctgtcttttccagctgctagaggccacctgcattaattgcctcatggcccctccctctatcttcagaggcagcaaccctatcattcagccttctgcttctgtcaccacatctctctctctctcttttttttttttgagatgaagtcttattctgccccccaggctggaatgcagtggcacgatcccggctcactgcaacccctgcctcccgggttcaagctattctcctgtctcagcctcctgagtagctgggattacaggcacatgccaacatgcctggctaatttttgtatttttagtagagatgggtttcaccatgttggccaggctggtctcaaactcctgacctcaggtgatccgcccgcctcagcctcccaaattgctaggattacaggcgtgagccatcatgatcagccacatctctttccctaactagcttgcttctctttgccacctcttaaggacccttgtgattgcattaggtactccatccccctggttatttggggtgatcttcccatctcaaggtccatcttcaaaattccttttgccatgtaaggtgacatattcacatgttccagggattagaatatggacatctttggggagagccataattttatttatcctactgagaagggatatactctcagactaaaggacagtccctagtactgattcaatctggctttatagaaaattcactatattgtcattgtatttcacagtttgccctttgtcttagctggtaagacagagcctatgataaggacttgtgtggcatgcaggtatttaattggcaaccccagagggcagaagcaagagatttaggagtttaagagagggtaatataagagtatattatcaaagttgtagtgtggacaacagaaactcaaatattcaaggaccagcatgtagacagcctcctaagatgtctactcagacaaagaatttcaggtggaaggacttgttcatctgcttcacgcccattggttgacaggaatatgaactccattctgctgctgggctagacatgcatgtgggctgagtgagctttccccagtatccgtagcatcagaaaagtcgcagggcagaaagaaaagtatccaatttgaggtgaattactgaccttgaagtgagtgtaagcctaactagaattctaccccagctggctgaagtgaaaggtgaggctgagaggaaataaggcaggactgcacagtccccaattgtactgttcaaatccactcatgcccttcattaagtcagctctgccactgagccttccagctgggaggcagccacaatctctgcagaagatttaatatacaccagtttgtggaacaagctgtagttcctgctgctgctgtggatcccaagccacagttgatatttgttgtctcactcatccaccatacattccagatttccctcacctaacaccccagatggaatggtttctttgcctgatagggtgacccagacttaacgaccctaagagatctgagcttttgatcagcatgcccttaacagactggggttgttgcaaatatcttttcattatcactggatatggaagtaaaaagaaccagtgaatcagcggacccctgagttccagacatactcttccttgtctccattatgtagcagtgttcaagattttcatgataatcaagattgatttctccaccagtatggtaatttttttctttgctcactggtctgccaatattaagagctcaaggtggccaggccagtagcagagctttagatgcagtagaacaagcagagtatcccctgctagaattccccgtaggaagccagacctttgattcagcagagcctaaatgtgtggggttgagtgaacttctatacgtgagtcattagaagtaatggtgagaggggccaacctgcagcactgggatagccctggtacagacgtagaacatgcttgaggaggttgtcaggaggaaatgagttagaccttgcacagaactaccaccatcaagtacagttggggtgaggcagacatggtatgagttgaggcatcagagatatctgatgctttatgccaaattaaaattaattttttcatggagtgacactgatccacagaccagactccaagaactttgcagtgactaaatacccatctcatcataactttcctggtattttcttctggaaaaaattcttccctgatacagttttcagaggcagctagatgcactgtcatctctccccttttcccacttccctacctatccacaatttactacccaatgccaacactaaagttagcccaacttccttctaactaaattattagtttagaaggaaagagaggagtcatgctaaggatcttaactgaaatcaaaacattagaggctgggcatggtggttcttgtctgtaatcccagcactttgggaggccaaggcaggaggatcacttgagcccagtagattgaggttacagtgagctacaattgtgccattgtactccactccagcctgggcaaccgagtgagactctgtctccaaaaaagaaaaggaaaggggagaggaggggagaggaggtagggaggggaaagaaagaaactagaaatccatcaattttaggaccaacttcaggtaaaaaaatgaattaggcaagttggtctttcaacattctctacctctctttatatcatggttgagaccacagacttctcacctcatgaaagatgaactctaactaattcatactaaagctaaagcctctaaagaggattaaatatgagcaatcccacgagaacttttttcccctggaattgtttattcaactgtcgttcgttatatggaatttcctgcctggttaagtgtaggccagtactttggatgaattgtagttttctagaaagacgcttcttatataagaacctctccagggaaacaggggcctgtatgagatgaattgagaaataactttacaccactgattatgtcagtgttctattctgcatggtagagatgtgaaagggcagactgaccattgctctggaagcctttacgctgtgagaagttaacagtggagtaaaatggccactccactctcttcatggaagccaacatggcttactaaatagtcaacaaccatgggagagacctgtggggtcttcatcagagctcaggatctcctagggtatcactcataaatacagccatcagggagatggagaaatctttgtgcagccagaaattctcaacctggttttacccatccttcccaactttgtattcgtcctactgtttactgacatggatcctctgcttcattaaccatcccttcctcaccacatgctctctgaacttggctgcaccttttctacctccatgccttctttgctcaggtttttccacataaatatcattatttccctctctactagctccaagcccaccctctctctggggcagctcagtcactccagggcacaagggggtctttccctcatcccacattttgagacctactacctggaccatttgtttgccttgtaactatgcttgcctttttaattgctattttattttccatgtattttcattgttcacacaagtcttctttattccacactaaggcaaaagcagagtcctgtgttcataataagtgctcaacaaatgttgggttgattgggttggagattccatcttagataatcgcagtcccatcatgccagctaccagactgtgtggacagccaggtcagagcagccaaatgatattctagcttgtggcacaaataccagcaacaaaataaccaaagtcacacatctgcctctgagttcctggcttctatttctcaagggcatttttaagttgtcttatgactgttccctttctactcattctcataaattgagctgtggactgctgtgacccacaagcttctccggaagtcaatgtataaaacaaacacggaaacgaagagtatggtgggtggagggtactccactgactctagaatggatgactgaacattccaaatttcaagcacaagttagggagcaacagatcattttccttttgaaatagggtttcttctgctcagccagttgttgtattttcattaggaaatggaatgggactacagcacaaaaaataaatataaaaggacccttgtagggctggcagaaaagagaatccttcctaggagacctggaggtgattccaggcagtggttgagagcatgggctctgatgtcagacaggcttaaatttcaaactctctctctattagctttgagaacctaaatatcctacttagccactctagcactcagtctctcatgtgtagcatgagggtgagtagtggtagacagtttatagggttatagtgaggattaaatgaaatgtgcttataaagtgcttagtactcagaaagtgtgcaaacagtaaaaaaaaatggtatatctagcaagttgcatgccttacttgtgagttcatgaagttgtggcaaggataagacaaatattttttgccattgcatcattatatcattgctaagagtatgccattattggccaggtgcggtggctcatgcctgtaatcctagcactttgggaggctgagatgggtggattgcttgaggccaggagttcaaaaatcagcctggctaacatggtgaaaccccgtctctactaaaaatacaaaaaattagccaggcatggtggcaggtgcctgtaatcccagctactcaagaggccgaggcaggagaatcacttgaacccaggaggcggaggttgcagtgagccaagatcatgccactgcactccagcctgggcaacaagagggaaactccttctcaaataaataaattaattaattaaattaaagaaacgacaaaagagtatgcaagaattttaaaacaacttagaggaatatgtatgaggatacaggctaagctaccataatgaagagacctcgaaatacagtgagaagcgagacagaagtatctttcgttccatgtaacactcaggtggttcagagcagctaagcagctatgttccatagagtcattcagtgatccagattattttcatctgttgctctgccattctccaggatgttgtccctataaaattgtcaaagctcagtcagtgccaaacccatgtttcaaccttcagaaagtaaacgagtggtggaaaacacattcaatgttttaaggccaagaccttgaaaactcactctcttagcctgaacttagattacatggctgggcccacttaactataggggaggcttggaaacatagtctctgagaagccatgtgtccagctaattccctaatactaaagttgaaagaaagaatggattaaccagcagtataccacaaggtaacaaatgactaggaggatcaggctaggtggactagaaaagagacagtcaattcagtgcaacaattccatattggcacttttcatgtagctgttgcttggctctatctagagaggactcagaggtagtttagataaggcctttgccctccaaatacagtctaagcagactgatttcctactggatgttcaactttggagtcttcagggatgagtagggcttctgtacgtggaagagactatgagggaacctgcacaggacaagggtttgcataaagacactgaggtagggacctctcctgttgtggggacagtgagaggcccaggtctccttgactcacaaagtgcttactaagcacttactagaaattaagaagcagattataatcaatatgggttatccaatgtttggatgagcaaggctccttatcttttcttcgttaatgttaatcacactcttttggatggagacaaatatctgtgggggctgagctttgggtcagatagatctgggtttgcaatcctggcattgacttttacttagcagtgatgacctcacatagattatttagcaactctgagacttacttcctcaactctaaaatgaggggctcagactaaataatgtctaatctcttctccagtaaaacaatccgtggttctcagatagcactgtgctggaggtagtggggtttgagggctgggaagttgggaggactgagcccttcccgctgagcagtttcgtccagtttttcctgtaccagcctgtcatgtttattccatgtgaatgactccagaggcaaaattcaagcttttgaatagggcacaaattaacttgagtaccctttcatttccctgtaggtgaacactcctctagccctgccttttgtcagtctggagcccttgttctaatctgtacacaccagaggactttacaaggctttccccagcctccagaattattcttctgatccaccctctactaaactcaccctttcctcagtgctaggacgttgaaaaaccgaaacaaggcaaagggccaattgtaataattcacactaaggcatgagtgactaggtttagtatattaacactacctaggatattctatttcttccaaaaggatcctgttaatccttgaaatttaacaactaatggtatagattctaagcactgtgagtacttgtcagtgggggaaagacatttttgggctgagagactttgccactgggaagagagagaggatgaggaggagaagggggatagggaggaaaaagagaaaaaagaaagaaagatgattagatgatagatggatggattgatggatggatggaaaaaaataacatgagagagtggtaaaaagcacagaatctggaaccagactgtatcttagctgggtcacttactatgtaacttagggaaagcttcctagtctctctgtgcctccctttcttcaccagtgaaatggggatcatagcagagccaacttcacagagtggttgcgaggagtggatgagctgataggtgcagagcacttagaatagggcctggtgtggagtaaatgctccacagagctagccgtgttggctgtcacccactcatgtggccagcctgttggtctacctcttagttgccatgtaacaggattctggtgcttttcctttgcccaggtcagatggaacccaggacccatccaacttggctgcttcacattttcatccccttctgcatcattgctttcattttcatagccacagtgatagccctaagaaaacaactctgtcaaaagctgtattcttcaaaaggtaagtgagttttattcatggtaacccaatgcactgggtgtctgcagcatgagccactgctttgcactgcaggcctatggcttgctgctttcatgctaaacccactcagagcttatgaaccactttgagcttgtcttgatgattatttttccccagaagaaaatggctctcatcgtcagtgagctgaacttcttacactgagttttttaaagggaatgttttgttcttatgtctgaaagagtttgtcttattctttgagccaagagctttcatcagcctcatgagagtgatgttattttggcaatgcagagagctacgtgctccgattttgctggtgggaggttgccaggatcctttctgaggattccttccattttcacccctcttttccccagtctggatatgacctgggttaaacccaccccctctcccaggaatctcaacctcacggttgggtaaggaaaggagaaaggtttgtgaggccatttggggataaggaaacagctggttggtggtgcattaacgtctttcagcagctcccttcgagtttctccttagcctgttgtattcttaccaacacactcctgttctgttgtaccagctgggacagagcatgctgaagcctttcagccctgatttcattgcttcattgttcatgtgtctgtctttggtttcctgggtggagcctgcccacaaaacccccagaatgtatgcaggcctagctggtgctttcctaaacggctcccttgtctgcactcaatgaacttctccaaagatctatacatggcctcatctatagaaagagaaatgacatgtggaaataattcagtaggagtttgcagcagcactatctgaggactaggggaattttaagtggttgttatcttacatttatactcataacttctatattttcatctgccataaaatattgtcatgttctatttgtccattgccctatgtgtgtatgtattcacttgggtgctgaccacaatatttctaactgtagaatgcaaggaattgttgccaaaagaaaaagacagagggagggaagaagatggccaggggagtgagggagaaagagaaaacaggagatggagaagaagaaagatagaaagaaaaataaatgtgggagggaagggagcttcatggtaaaggaggaggtatgtccaacagaacttcgacttttaaatagaaccacttcagagagttgtgtcaggtgcacctcagttgtcttatcttctgccattcttcttttacctctcacacccatacctcagggttcaaggcctggggcctgaggactccttaataacttcagaaatgagcagctgagtgttccgttccagctgtctttgggagaatggaatggagtcacactcaaagatagagtggaaataaatcctctcctcatccttcaccccaatcttaagagtgagtgaggatatcagtagctccgagctgggaggtaaagctcaagttctaactgtgattaggagacctttcttacaaataagaattaagtgaataaatgtgcaaacaatttcttttatatttttaatgaaccagagagaaatcatggttgcctatataacccttgtctccaactcacttgcattcagatctgctttcttacatgtgtctgccatgcacacaaacttgtgtgccatggaaaagggttgagaactgctggtgatgcagacagagctttaaaccagggtcagagggctaggctgggaccttgtgctgccatttgttggctttctgaccttgtacaaattgcctatcttctttgagatggtctttctatctgtaaaaggggaagcagcaagagaaggaacattttacagcttattggccgaacttcactgccgctagtgtggttcaacttggactacagagaaatcttcctaactggtttccctgtattcactcctgctacctccaacttggtctgttctcactttttgctataataggcttttaaaaatcataaatctaccatgtgtcctctgtccagaccttctccatggcttcttattgctcactggatgaagttccaacgagcccaggatggtttgactcatgtctccagctttaactgcatcaccatcaccttcattgtctaaagctctaaccacacaggattttctagtcctcagaggcatggcagtctttcaattccgagttttctcatacaatattgtctcttcttaaaatattttttcttgttgtccacctgagttggagtcatcttttaaatctcagctaagcttatacttcatcaagtctttcctaattctacctccacgcaccacacccattacattaaatccccttattatatgtttccatagcacctacttcttctttcagtatactcagcacacaatcacatgtctaggatctgttttaatagcttggactaccaattaaattgcatcccttttaattttccaattgattcctcaagtacccacatgcccatcttagcaagaagttcagtgtctccctcttatagcatgtacttctccacctcccacaaactgccagaaagcttacttagcccacagggccagtgctaggcagctaggttagtcctccagagggccctggttttgagcagttgctgtctactccggccatgcagaatctctggtccttccagatgtctccatccactgtgcaaaggtaaccttgctggttccgatccccacacagaccacagtgctacaagattacagttcttatggttccccaacacatgctctgtcattggtcccaaagcaggacccctatgggttgatgaggtaggaggaggtccctgccttagccacagctgcacacagccagcctcttcccttctaggccctcatgttgagcctgggacgccagtcctaacttccttctcttcagttcctcttagggccattggtatcctgaatttcttagtccattgcaaagttaagtaaagaagcagcaggcttggtccctttccttccagatggcttcttagctcctgaacagatttacccacctatacctcagtgactagctctgtgtactaaagtgtattgggagggcagccattattggtccataaaaggtcctgcttaccattttcccctaagaggaaccattcaacagtttggggctcgagggtgacctgctgggctctagagaagaagctggcaacttctgttgcaaaataatgttaaattctgcttcatctgcttgtctttacgtttcaagaatacagtaactgtgtttctctgattcaccaatatatgcccagtgtctaaaaaattacctggcatataataaatgttcaatgaaattttaaacattgaacctactatatgcaggtgagtatgctagatctgctctgtccaatataatagccatctgtggctctttttaagttaaataaaaattcatcagtcacatcttaagtattcacacactgtaagtgctcaatagccatgtacagataattgctcctgtattggacagtacagatatacaacatttccatcattgcagaaagttctactgaaaaccactgtgctagaccctttacaaacttctcatttaatttcacaaaaattgcttgtggcaaggagaagtgtctttatgctggagttaagaaagtgaggctcagaaaagttatatgacttcccaaagtcatacagctgggatttgaatacaggtctgtttgactccaaaacttgtggcctatttgttgcaaaagtgcttaatacaaattggttcagtcaatattattatctttgaacaatggaaggagaaagtaagtttcaatccaaaataattgagtgacttatacattgacttgctgagccaatggcaaagtcaagttagaatccagcagaagtcaccagctacagaatctagatctttagaacatgtcttcagatcttcagaacagtgtttcttaaactctcttgtgaaggaacagttatcatcataggctggtaacagttcacctaccagcaccagcccatgaaccagactctaagtggcacagccctagaagattgagccagaattttacagaggtttaaagaccaaatatgctggtttatggttacctgtggcccacagagaatggcagcactaacctcaggcataaatgaggtacccactgaagccaacattcaagagcaattcctatgggttaaccattgggctcctttcaaatgcaaaccctcatgaaagagactacagtgctgaatagagacctccaaattccaggccaagctcaggatagtcatgagggaattactaaaaacctggtatatagggcaaaagcagaattaggaatggactgatttcaggaacccaggcaatggcaggagttgggcattaaatcctaaaagagaatcagagtgggagggaatatgtgaaatcagaggttaagaaaaaagtgaaaacctattcatgattgcaaagatatgaaaccaacctaagatcccattgacgaataagtggataaagaaaatgtggtatatatacaccatggaatactactcagccatgaaaaagaatgagataatgtgttttgcaacaacttggatggaactggaggtcattattccaagtgaagtaactcaggaatggaaaaccaaataccatatattctcacttgtaagtgggagctaagctatggatatgcaaaggcatacagagtggtataatgggcatgggagactcagaaggagagagtagggagtggcagtgaggaataaaaaagctgcatattgagttcaatgtacactatttgggtgacgggtgcactaaaattcagacttcaccagtatacaattcatccatgtaaccaaaaaccacctgtacccctaaacctattgatataaaaaaaaaattaaaagaaagatgtgaaatcaaggaaacttactggtgagcagcatcccattatgtgaacttgtgcttctgaaccagtaacttgagttactttgagccagtatcagtcacttataccttagtgcaaaattaattgatcagacattctgacctggaccagggaaggcaggcagaagtagcagtcaagactaaagcagaaaagggagagctaattctgcagccagacatttcctggattgaatacccaaattagtccctcagcctttaagtgcctgagggccaggagtagacagaggaatggaaagtgtgagacttctttgttcacactctttgcctaggggccagattttgctttatgcattaccatccgaagtcccaggccacagtgaacatttgggcttcgctatgtggatttatttagatttactttttgtcctgccatattttaatctataagccaaacagttttctcattaatcttattccatttctggaatttttccttttcagacacaacaaaaagacctgtcaccacaacaaagagggaagtgaacagtgctgtgagtaagcatgatttttacttttctttcttactttcttttctctctcagcttgaattttaaagtaaccactgttctattaattcatggaaggcaactgaatagttccagcttatagaatcttcctgtttggtagcatttcagcgaagcctcgttcttagccccagaacaatcatgccatcttttgctcggtctatattcctaagcactcctagatgatactgcactggacctctggtctcacatagttagaaacagagttaaaatcgaacagcaaagagaagatattcaactgcgatgcaattgacaatggatgtttttgcaacaaacaatgattaagaagtacattgttgtgggctctgagtcaagagtaatatgggaaaaacacaagtctcttcatgaggttgacaggtttggagctggaatctgtggaggaggaaggatatgatctaggggtcagaagaagtgggttactaaaatcattaagcctggttggatgaaaagcttagactcaggggaagcagcacatgattgtgggggctggcaagtttgaaatgtgtagggcaggccagcagtctggaaacccaggcaggatttctaccttacagtcttgaggcagaattccatcttttctgggaaacctcagttttttgctcttaaggccctcaactgattgaatgaagccaacctacatcatgggagataatcagctttacttcaagttaactgatagcaaatgataattacatctacaaaatactttcacagcaacatatagactagcatttgactaagcaactgagcaccatagccaagatgacacataaaattaatcatcacaggcaccaagagatgaggggggcagtcttggccatatatttggctgaagtaagtcaatttgtcattcctgcatgagcctttataaacagaagtaagtaaccaactactatttggtcattggagttgtccaagaggccagggttctgtctaatacctgttcatgcatgaacatgccaacctagattgcatgcagactaccagttttgggtttttgtttagttcagcaggatttttctcagctcactgcctctcaaactttcagcaacaaaaggacatctgtgatatcagaatctaccactctaagtatttggatgcaatagcaatgaatatctgagtaaatctaggtggggagtgggggcaccctgtagccaaaatgatttaacaaaatcaaaccaaaattttggaaatgatgccttggtacaatgaagagactacttgaggtaggtttgacttatctaatatcttattttctttaccaatacctaatgaggaatttaaatatttctagatagctttggaaaggtcccttaaagaggcaccagcataccactgccagatctaatccccccaaacactgttttcatcatcatcatgtcatctcttgtctctatagatcatatcaaatccttcccagagtttttcaggccttttgacaactagccacatttcactaagccaactcatctaccactcttcaacaaaacttttcctcaagttgagctgctccaccaacaccactgccatgagctcattcccacttctgtggctttgctcatgttggttatttttttggagtgtcctccctattccttcttacttgtcccaatcccaacttttggcatggtctactttaagatacagtaatgagtaactttattattataacaccaggcttctgttctaagacattagaagtgtgtttagactagctcatttaatcctcacagtagccctctgaagtacttactccctgcttcccattttataggtgaggaagaaaaacatgaagaggttaactaacttgcccaaggtatatagctaataatataagggccaataaattgattcagcaatccaggtgtccaagtccagaatccacacccatacactacactctgcttttttaaaatttaattcaatttttttttagagacagagtcttgctctatcacccaggttggagtgcagtggtatgaccgtggctcactgcagcctcaacttttggactcaagctatcttcccacctcagcctcctgagtagctgggactacaggtgcatgccaccgtacctggattttttatttttattttttgtagaactggggtctcactatgttgcccaggatggtctcaaactcctcggctcaagcaatcctcctgccttggcctcccaaagtgctgggattccaggcgtaagccactgtgcccagcctacatacacaacactctcttgcttaatctgtaagactctctcccccactcatacctttttatttttcctctgcattgtacacacaatctataccactcttaagcacatgattacagcgttattttctggctgcttctatgtgtctatattttaggtccacctggtcaatataataaagtgggatattagtgttaatgcaactatatggtatttgatatttgtctttctgtccgtttatcaatgtttcttatagtttattatataataaatttaaaaggtgtctgattttgaccaaatttgactaaatactaaaaaacaatattaaaataaattttgtttaattttagttgagtctatcaactcaaaaaagaataacgtacaacaataacaagtttcagaacattttttaaattactgattttatgagtataaaaataaaaaataaaaaagtataaagaaaacaaaaataatttagaatccattgcctagaaattgccatggttaagattttaatattgctcaggcccagacagctcagggctttgacattcccacacccattctctgccatcccagttctatctcatcccaaaaccatccattatgaggagagtgtacagctctaggctgcccgggagccatcccgcactctcattttgtgactcggcatcttgggagatggagtcttgggacttagcctggacatgtcccttgcatgtacttcttacaagacttttattcagatgaatattttcccttccaacttaagaagcacagggcttgctggttttgcttcactaaccagcaactgaagcaagacctgacttgtgaaaatgcctaatagagttcagtattagcgctgtttcaccatttcctggatctcttgcctttgtgcacatgatagaattgcacttctctgtgattaatttgtagttaagtgtggtcatgtaactcgctttggtcaattaaatgtaagcataagtgatgcgtgttatttctgggtagaagatgtaagagttggcatatgctttgccatattttctttatccatctggcatggtaaccagtaacattctaggtagtaattgctccatcagtctcagtctctgagtgactaaaattgacagagtcccctgctgaccctcaatgtacatggaacatgaacaagaataagcttttgttttttatattgagattttggagttgtttgttcctacagcattacctagtttactctaatacaacatggaaaaaactggaacctataataaatagaccctacgttgccatttaaacttctagttctgaggaataataatgtggggaaatactttctatataataaaaaaatagaaaattgcaaaataaaaatatacttatgtatcattcatgtcctattaaaaatgttatttatagactcaccatattcccttcctccagaaaaacagaagtaaaaatatgaaaatgcctgtaatcatgtttttggattatggaatcaagtattgctttttacttttatgttttctgaatttttgttgtacttcactacatttttgagtgccctgatgtattactttcaaaaagaagaagaatactttctgaagccatttcaaccatccccactcacctctctagatcccagtaaccaaatacattatataggactcttcatcagtccttatcaagtttaggaagggcgatgctataccttctttaaaggacacctaccaatgtcttagttgcctttcaaagactcctagcacagctaaatgtgatggatatgctctaaggatataagagctgaagtgacttgcataaggtcatatcataacttactgttagaaatggagctagaactcagacccactgagtccttgtctgtgacacactgccctttccatttgtggaagttgttcttgtatctaactttatctgtgctactatttgggcctagccattctccctcttatgcagacaagcagataaacagtaaaactttaggagtggattatgataccatagatatatatcatctatcctttacaaaatagttattacagtcatcaagccttggttagagtttacagaccatgtatcctagctacctcatttcacagattatgacattgggggctaagagatattaagtgacttccttaagtgaaacagtagcagaccaaaagaagtcatgattcccagcatagtgctactcactcatttattcattcattcacccactcacaaacctgtattaagtttctgttatttgcaagaccctgtcagttaggccatgtgggaactagaaggatgaatttatcagtcatccaagattcttacaattaagtattaccgataaggtactcaagaaacagttctcattcacataatttgggttaaaacaaaaagaagccagctttctatatacttttggtccagtctttacgttttttgttttgttttgtttgttttcatgagtatcccgacttccttctaagaacttccacctgagaactgaccacagcgtcagcattccacatgggtgtgtttcctttcccctttcccatttcagtggtttccaatttctttttcttttggcactataaacctttcgcaaaggaaatattagacagaactcctacatgtcaagcaaattaaaatagtggtgaaattagagtggaggacataatcaccctatcatataggctatttgtccatatcatatttgtccctacaaaggcctctaaggcaggggtccccaacctctgggccgcagaccggtaccagtggcctgttaggaactgagccacacagcaggaggtgagcgggagacaagcgggcactactacctgagctctacctcctgtgagatcagcagcagcattagattctcatagaagcgtgaatcctattgtgaactgcacatatgagggatctaggttgtgtgctccttatgaaaatctaatgtctgacgatctgaggtggaacaggttcatcctgaaactatagcctacccccactcccacacccaatccatggaaaaattgtcttccctgaaaccagtccctggtgccaaaaatgttggggaccactgctctaagataccttgtgcttcttggaacatatttggaaaatcatgtagctctcaaattatccctatgtcctgaagcccaccttaccatcaatcctcagaaatacccaacccatgtcaggcaacttcacactttctttcttcaggcagcacagttgtctcagggagggaggagagtgctattagcaagaggagtcactaacagcttcactcacctgtgcccatgaatttttaatggtgtgaaaagtctgtgtattttttatggttctctatggctcatataagagggacaaacaatacatgaaagttcagagatggggacaaatatcactttaagctggggataatcagggaagaagaaagttttcatggagaaggtgacttttgaatcaggaagaaatggaaacagcaaactcttctagatagaggagacactaacaggaaaggcagagaggcaggaaggtgtgggaaagtgcacgtgaccccgttcagagagaaagccaggtgtgagataagggggaaagactgttagggcatgtattgtaaaccactaattccaggcaaaagttagattttacttactaagcaagagtgcttcagttagatcctagcaggaaatggagggtatgcttagaagaggtaactgaggcaagtttaatttataaaggtgtgtgcagcattaagggaaaccagcaagggatactgagcatgccaggatgcaagagcaggcagggaaggtgactattcctaggtctgaaggagaaaggggagggagcagttcccagaaccctagtaaaaatggcaatgagaaaggtccatctggcaggacctatggtctttaacagagggacaaagtcaacccacaacttgtctgggaggttgctgaggaatagataccccaacctctctctcaacccactgcaacactctttttcccctagactgagcccagtcaaagacagagggaggagcccagtgatgcagtctgcaatgtcatcatcctggagcatgaatagagtgcagcagggtgaataatgagtctgcaggaattaatagaaatatctgacacaatagggaactataagaggttttgaataggagaggcccctgaaatgtgctccaatattactgaactatgtgtggcccaaagaatggaagaggaacagctcttgcaataggtctgaggagagaagctgaagacttggactagggcaatggtaaaaactgtggaaagaagttttaaatgaaaagttttaaaccatgcggcttccagctagatgaacttttttaaaaaaattagttcctcactcaaattttggggaggttatatattttctaatcataaaaaatgatttttcttatttgtgggcttttctccccagatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaacgttctttatatattctacttttgggtaagaggtttgctcagggtcttgcaagtcagtaagtttaatatcctattacgccatttggctcccaaagatttgaaggcctttgaggcaaacttggatgtacttttcagcagggttgggtcctagggatgcttgatctggggctcctgctggaggaggagcacttcctaacaccacagagagcagggcaggagacaaggccttcttccctgg

SEQ ID NO: 88 - DNA, 12507 bp, Homo sapiens
  1st PDCD1LG2 Enhancer
tagtgctgcaataaacctagcagtgtagatgtctatttatgtctttatttatttaactattttatttatttattctttatttaactattttaaagctgagaaattcaaaattaacttttgttctattgatatatttggccaaatttgttaagacagatacacctgtttttagaatttttcctatcccaggcttccaaagtttcaagaaaattgatataataaaccaacttattcccattataatttaaacatttccgaaattatttccattttaaaagaagttaatgtttgaccaatgaagcaattgtcaatgatggggttttattatgagtttaataatgatatttaccatttattgagcatgtaccttatgcaaggtcttcatctgtcaatcatctcttctttctgcaaatacaagacttagcaagcttggagtaagttatgaatgctaacatatgtgagatcaaatagtctctttctagggcactgaaggtctttggggacttaaaaactcgattacaatgattcagtcatataagagaaaattgcaacacacacacacacataaaacagaaaagaactatttgtacatgccaggaaacactgctctaagagttgctttattctaggtgactatgaaaggaaaaaaaaaatctaactatagagaagttaaaaaatgtacatatatttgggaagaataggaaatttcaccaaaggcctggagtcactcaaacccgagttccaatcttcttagatgtaaattaacttcattgaaccagtttactttaaaaattcttgtttttattaaaaatttcaattactattaaaattatatttttaattaaaaatactttaaaaattaaagtgtatagtttttctatttatcttaaatattcaaataattgtgaattaaagttgtgccagcttgaagatttaaagtgataggcttaataattttggaacttttcttaatgtcaaagttaactagagcttcttttctttttcaaattacacatttaaaattccggcatcagttcctttttgagtcatctaggtctctcacgtcagtaaatattgagctactgtaaagctgaagttacttacgtagtaacataacttacttaggggagatttgtaaatgtttattttggataagctatgtcttatttttgttttgcttttgagaaagatacttctcattctttgctaatttcaaacaaacagctttatagtagaaagcaattatttctataactcaagttaaataattctgtctattctttagtcaaattgaaaataagacataacaaaacaatgacccccttgccttggtttctaacttttcagaggtgaacacaaccataaatggtaactaacttacagtagtgcctactgtatccactaagcattatgtagaatacagaggtgacccagacatgcaccctgcccttaaaaaacatgaagattgaaacatattatcatgatttacaggcatagctcctcctcctccaaaaacaaaacaatacaaaacacacaaataactgtgtttgtcagaaatacagacaccaagtgttaaaatgtcagaaaatagggcagcttgaactcaacctttgcactctctagcacttgaattatattttatcaaacctttgttaagttagttcatgtattttggtgcctcagtggttctaatccaagtatagtatttttgtagatccatctgtcccagtgctgcataacagcactagaacatgtggaagagatttaacaaatagtattagctatgatatgtatatattagtatatattacatgtcaggaagtgttctgagttctttacgtgtactaattcatttagccttcccaataaccctatgcggaaagttattaccatcttctcttgacagataaagaaaccaagccacagaaagtttaggtaacttggccgaagtcatgctactaataagttatggccccaggatgtgagcacagtttgacttcacagtttgctcttataccctacactatgctacccctaaataattattcgagtcatgttaatgaggggattttaaaaacttgacagtattggaacagtatatatagtaagctgatacttccctgggttggacaactccagaagcaatctgatgtttgtttgcctgtatatttttgtttttctaggcaatgggggctaatctcactagtacttctgtagactgtctagcatatgtctttcggtgaatctttgaactcgttttccatttggtatatatctgatggtacaattgctgaattcttggtatatacataagaatagaatttctaggtcatggtataggattgctggaaactgtaccaatttgcattcccaccagcagggcataggagttccagttgccttgcatttttcccaatattttctgcctctttcattttaggtgactatgcagagacatcacattttggttttaatttgcatgactctgatgactaatggagtcaaactcattttcatatatttattggccatttgtcaataaagttttatgaggtgtcttttcaagtgatttgcccattttttaaattaggttttctgcctaattcctaattgtgtaggaattcttagcgtattctagatacaagcccttcgtcagagacataaactgaaaatctcttctcccattctgcaggatgtctgttctctcttcacggagtcttttgaggaagtgaagttcttactttacatagttcaatttaccaatttttttcctcatggctagcacttttttgtgtcctgtgtaagcaaactttgcctactccaaggtcatgaagatttcttccatgttttcttctaaatctctatcattttatttttcacatttagatctgtaatccttctggaattatttttttgcatatggtgtgagataggagttaaaatacattttcatgtggacattcaattgtccctacaccatttactgaaaataccatcctttcccccactatactgcagtgtcacctttctcataaactagttgactatatctatacctatgtctctatctatgtctatctacctacctgtatatatctgtttatggagtctgttctattacattgatcagctcatttgttttttttttttgtctagaaaattttgctaaagcagtattaatgagtttgaatcttgcctcttggggctgtgacaacacttcaggttgtgattcctcacctgcagccctatccatgccatggcaaccaccgaggcatccatcctgtggttatctatacaatgcataataaagacctcagctggcctcggcggctcacgcctgtaatcccagcactttgggaggccaaggcaggcagatcacgtgagcacaggagttcgagactagcctgagtaacacggcaaaaccccatctctccaaaaaataaaaaaattagctgagcatggtggcatgcgcctgtaatcccagccactcaggaagcagaggtgggaggatttcttgagcctgggctatcgaggttgcagtgagccgagatcgcgccactgcactccagcctcgatgacagagtgagactctgtcggaaaaaaaaaaaaaaaagataacctctatctcccactgctttcccttcccaccgtcaccccaagtttctgtcatttctttgaatttgttatttgactttccacaagtataaaagtacacttgtatcatttattttaggtattggatatcttcccttccttatgtattattttaaaagcagctaaataaaaaatttagcttggtttttgttgttgttgttgttgttttgtttttttggttttttgagacggagtctcgctccattgcccaggctggagttcagtgacatgatctcagctcactgcaacctctgcctcacaggttcaagagattctcctgcctcagccttctgagtagctgggactacaggtgcatgccaccacgcttggctaatttttttttttttgtatttttagtagagacggggtttaatgtagccttcaaataatttttttaactataaattcagtggcttttgatttttcaaaaagagtctccactcttacctaaaactacaatgggtatttgaattctagaaggaggtgattttattccaaactgataatcactataaaacattatgtcttttctactggaaatagaaatacagtgtatatagatgtttgttagacatctctaataaaaaaatgagtattgtatataactgagccttcctagaatgtttgcccacagccacagtgttatagcagttcatattatctctctcatggtcacatgttagaagtagagtcatgtagcagtatgcaagcaaatcccctgttgggatgcctgttggcttcagattagctcacttactgggcaaaacagagactatgggcaatgcccaacatttcctcatttctcataatggcttatcaaattcccagtcacaagagctaaaaccttagaacaatcttttactcttccctcttccccatggcacagctttaacatcgactgaagcttcttttatagaattgtttctccggttccttttttgtgaatttattgttactattctctctcaaacttcatataggatgttgacagtgacttaagcaataagaaagattatcacataaaacaaaacaaaacaaacaaacaacagcaacaacaacaaaaaatatatatatacacacacacaggtaggatggccctgtccctgcttctctgcgatcctctttgttctaccctactggtggatctatacccaaactggcagcaagatagcttggcagttccaggttacacctagcagaccacatctcatgtctcactggccagagtcaggtcacatacccatctttaagacagttgttggcaaggatttaccctggagccagggatgaaaccatcttcccctgagtcacatgggaaaggacacctgaacaaaattagcgtcttgtcaccatagggaatgggctctgaatgctggtggataatcaacagtgtcagctccagactctaaccacttcacttagataactgcagccacctcttaactgtggtccctgcctccagtttttggctccatcttctcaacatgtataatgaagccagtacaattctccttaaacacactgctgtcatgacagcactttcttggtcagggggcctaggtggcttcactgtgactgatggacaaaattcgaacaccttggcctccccattcaagatgtccacaaccagactccaacctatcccttatccttccttctccctagttccttacaacaggggtggtagtaaatatatcaggctttgtggaccatgtggtctctgtcacaattacagtaatattcccctcatctgtacagtagaataagttgttctgagaagaagaaggagaaagagagagagaccacattcataccacctttattacagtacgttgttataattgtcctttttttttttttttttttaactcttgtcttgctatgttgcccaagctggtcttgaactcctgggctcaagtaatccacacacctcggcctcccaaagggctggaattacaggcacgagccactgcacctggcccgaattgttctattttattagtagtaattgttgttaatctcttactgtgcctaatgtataaactttatcttttctttgcttatctgtctttccacaagtataaaagtatacttttaccatttattttatgtattggatatctctctaaacaaatcacaggtatgtatgcataggaaaaaacacagtatgtgtagggtttggtactatgcacagtttcaggcattcacttggggatcttggaacataacccctgcagataaggaggggactactgtagtcaattcttcccttgtagtgcaaaagcagccatgcacaatacaatacaaatgaatgtgactgtattccaataaaactttatttacgaaacaggcagtaaactaaatttggcccacaggacacactttaacaatccctgccttacatgaaatcccttactccactaggccctaagttggtaaaatcaacactccattggagccacaaagatgacaacataatggtatggggaagtcctacctacacaggacatctggcagggtccgggcttcatgtctgacatatcgtcaagagttacattggcaatgagactagttttcgtaaatttattcagtttgatcattcagctgattcaaagatcaaaagatcctttagggctgtgttttctgacctttttaaggctgtggtacatggatttgttaggctaactgagacaaataaatgagtttgtctcttcactatgctgataataccttggcaagtcatcagtcaagctctttttctcacccttacccccagatctacaccctgctcctacaatcttatctctgtctccttctcccttctaaaagaaacctgatgaaacaaaaagaagaaacccagagataataatacacccaagatcatactgatagacctacatgtgccaaacattggttgagaaataatgtcttgtgatccacaataatcagtaccaaaaatccaagtacttcacgcggtcttaggaaacaaatatgtgggaaaggctgaggcttggcttatttagttagcttttgttttagaactacataaacagagagtgtaaatagtaacctgattaaaaatacggactttagggttagtttatctgggtttgaattctggttctgctgcttcctgtttatctgacctttggtaagtgacttaacttctttgtgtctctatttcttcatctacgtatctgacccagagagttgttaggataattatgtgaattaatatgtgcaaaaatttaaaaatagggcctatcacattgttaacagcatatatgagttggtaaaaggatatatatatatgttgcgtcttaggcatggagtaaaattcatgtaaacaaaaaaacagagtgaatattcacttaggcaggcagtctgctccatgtaatcattcaaggattcagatagacaacggctctgccatcttcaacatgtggtcttcaaattttccctggaggtctccatacagttaaatagactagaagggcatacagaatctcagtgggagatttttatgcgctagatttaggaatgatgcgcataatttcctttcacattccattagttagaatttagtcacatgaccataacctaatcccaagggagactggaaaatgtagggtagcttcccaggaggaagaggagtatatagatttgatggaagacctatcagaattggttataactgagtatctggacaacaccatattggtactggtatcctagcaagaaaagtgtacattgaattgtagtatctatagtgccattagcctttcatgaagttattttaataaaacaacttttttgaaactagttattaaatacggtctaaaaataatgatgaggaactctttatttcattacctagtgtgctttctaaagaacactaggaaaaatttccctttgaccttaatacaaacacacaaacacaaaatagttgtgtttccccgagtgaaaagttgcttagctttgcccctgctccccaaatcttggaaatattattaattgtttaactgtccaagcttggcttagaaagcttagaatcaattttattctttcactcaactaatttactgagcatttactacatgtcaaacttcaagctagacactgaggattcaagagggaacaagacagacatggttcttgccctcatggaattcacattctaataaggggtcaaggaagtggatgtgtggaaacatataacgaataaacaaatgactatataaatgcagcaataccaatcaataagggaccaagctaaataattgccaaattgggaaccaattttaaatgggatggctgggacaggggcttcttcaaaaaggttgaatttaaaccgagccagccatacaaaagggcgtacccccagcaggaggcacaatgtgcacaggagctttgatgagagattgagttaaggagttcaagggctagaaaggaggccagggtgactagagagtggagagcagagcagggaggggcacaagatgagactgtgcatcacgcaggcccgtgacagccatggtgaagagtccaaattctgttctaaatgcggtgggaagtggttgcaagtttttgtttgtttgtttttgtttttgttttgagacagagtctcgctctgtcaccaggctggagtgtagtggtgcaatctcggctcactgcaacatctgcccctcgagttcaagcgattctcctgcctcagcctcccaagtggctggcactccaggtgcactccaccacgcccagctaatttttgtatttttagtagagatggggtttcaccatgctggccaggatggtttcgatctcttgaccttgtgatccacccgcctcggcctcccaaagtgctgggattacaggcgtgagccaccgtgcccggtcagttgcaagttttaagtagggggaaatgattgatccagcttgtgttatgagatcatttgggctgcagtgtggaggaagaactaaaaggacatggaagcaggaggacagccaggtgatgggtgtcgtaagcctgggaaatgtgatggtaatacaagcatgtcaagcccgcagatcctgacagtaagcatgccttcctgacttgtgcccggggagaggaggcgacagtgattctgacctcttcttatttccctccctttctagcgccactttcctgagcttttttactgtatgttatgtataccgtatgctgtatgctgtatgctgtatgctgtatctaacagcccttgtaaacagccttaaatcctttctaaacatcctggatagtcctagaatcctagaatatggattctttcttggtttcaaaactgatttcattatattgcatggaaagaagaaatgtctttattgtagagtgttggtatttctgggtaggttgattcaaagattaagttgtgagggcagttgggacttttagagaaagtggatctagaaaatctaaattgttactaagaaatattgatgaatgtaggtcatggagctcagaaagaagtatctctttgatatttttcctaaactatgtgaaagggaagcaatgggaaatttcgtgaacggagtcaggaaagcctcaagttgggtggctaggaagggtagaggagttgctattagggaaccgaggagtgaatgtggagatggtgaagtgagacaggaggctgcttcctcaaaagtcaggacagttatgagaatgctctggtttgaatgtcaagatgttactggaaatgaataactacaaatacacgcatgttcatgcacacacacatacacaaacacatgaagctattgaaaagaatatgcagcaaatgtgttttgtaagtgagctagtatctagttgaagtaccatgatcatctttaaaatctcttgctagaagaggaatgttgactgcccagtgtgggtgtggatagggaatgaatatcctcgctgtggtatccataattgaaatgcactgtgcctcatctccagaccagcccttacagcagtgccaatctccttcttgtccactgcacaatagctcgctgactctgcctactctttggtcagtttcccggatatccttgtctcttcattcttagtacatcacatcattactcaggcctcttgcctgggcccctggcagctttaggtacctcattcagcgcaactgttttcctgttttcttgagcagtgaggtcataatttcatgaccttggatacacattgcgtgaagtaaaatgtttattaagtcagatgaattaataacattttcaggaagttcataattgatggagacaaattacatatgtaccatacatcaacacacacacacacagaatgtgcacactcaggagagattaatagtgtgtatgtttattagatataaagcagctgtagcctatgaagaaaggacagaagaaacagcgaggtacaggaactagagtcgacaaagaagaaaagcaaagatgcccacatacatcctacttttaatgcaaagcttgtctctgctggataacatcacaaatcccccaactaaaatcaccaattgttctgtccctaaagatatctttctagttctcaatcccaggccaggtggggctctatttaactctcttttatttaatccacttttgatcactcttaggaagtttcactttactcaacaagctcaagattgatcacccttgactttatctgtttatcttaggagtgtttggttgaagacagaaccacagatgcccattattactagtattatcataacaataaagaggagcaatagtaaataaaggaaacccagagccagattatcgggacttaaatctgttttcccacttttgtgatgtttgaccttcagcaaattatctaccttctctatgcctccgtttccctattcataaaatggaaacaatgaaagtacctacctcgtagggtttttgtgagagttaaatgggttcatacacataaagtacttggatctgccctggcaatatttagacctctgtgaatagtaacctgtattactgcgtttcagttaggaatgactaaatgttgcggcaaactgcacattctgttgacccttcctggtcactgctcacccatccgaagcctgtgtaatacaatattcaactctgaaactgcatctaaggtggccaggaaggaaagctggagggaaatgtgtagaccagctgacctctattttaggttgaaggtccaggcatttcctcccctttctctacctgtgagaggagccaaccagagctggccaagccatgatgcagcccctcgtgtggccatttccttcccagcctctattcatcttttaccactctctagcagcagaagctggtgggttgtggttaccactcttgtttgttgccccacatcccagcttcattttctcaggatcactgccaggcaataaggaaagtttggggcctgaaaaaatctgccccaggcctgtgtagagcaaaatacccttggacattatacccgcagaaggttcctcaaaattatgtgacatttttcagctgatcgaacttccctaacctgacttcctggaaaagccaagaattcagagaaaatgtagggcactgacgaaccaatgaagaggtcagtaaattctcccggagtccccactcaggtctgaaaaatgttgtgtgaaacctgtgggtagggatagcctccaaatatttgccctcccacaactgtccataggcctagttgccctgccatagctaggtcccaaattgttgcaaaagccataaagccatatccatgtagattctgccaaaccagctaactggccaatctgttttcccacaacatgagttaccttactgggatgtgcgtcttcaggtatatgcacttggatccagttacagcaagttaccccaaggaaataatcagacaagggcatagagctgattgtgaagggtcattcatggtgcccatggttttgtaatatcaacacttacaaattagaagcaacctaaattgccatcactaggggatggcttaaacaaactatggcatacccatacaataaaatatttatcagtctttataaataatcatggggtctgtaattaccaacatggaaaaatgcccatgatacccttgaaaagtgataaaacagttcacggaattacattctgatataatggtacttattaaaattgcattctccagcctgggcgacagagcgagactccgtctcaaaaaaaaaaaaaaaaattgcattcatcaatgagaacacttggacacaggaagggggacatcacacactggggcctgtcgtggggtggggggaggggggaggggtagcattaggagatatacctaatgtaaatgacgagttaatgggtgcagcacacctacatggcacatgtatacatacgtaacaaacctgcacgttgtgcacatgcaccctggaacttaaagtataataataataattaattaattaattaaattgcattcatatgaatggtacctattaaaattgcattgatatgcaattttaataagtaccattatatcagaatgtgtccagggatctacagaaaattatgttcacaaaaatactgacagcaattatctctgtggttgagtatttgggtaatatttactgttattttttacttttttttggtatttagaaaacacttagcaatgatacaatgtgctatctgaaaaaaactaaactttttaaaatataagtttgaggggaaaatgaactaagttagtaatgttttgggaataagatcatgggttggccacaccaagcaggtaatggcacaaggataagataattaacatttattaagcacttattacatgccagcaggccctgttctaagcactttccg

SEQ ID NO: 89 - DNA, 5612 bp, Homo sapiens
  2nd PDCD1LG2 Enhancer
ggtggtggttcctagccaaagccaaaaatgagaatgtggccctcaggctgagggctttctttgagaggacgtatgatttctgggctattccaagcaccacaaaaaaaaaaagagtccccatggtggcttatacatgccaatgtccctatctgacagaaacggtgactgagaatattgctccatctattcccactatccagtgagggtaatgacaagaagacaggatcactcagaccatgtaaatctaaactgatacaagagggcaggggttgagttcccttaaaggtgagatgccaagcagctgtccccttcctttctggcagggagagtaaggagacaatggccagggaacaccgttactctaaagataatgtcttgaagacattctgcatattattagttgtttctgtgagtttcttttttgaaaagcaacaatagcagccgttggtcattcataccttaatgtggtttactgagtcttcctaaaacccaaatgaacaatgaaccttaaggctatccctttggacttgaagaaaggacttctattggaggatgagggtgagcagaaagaaaagcagtttcacagttggttgttctcctggggaaggtagttcagaccattcgagggtgtagttagaaccatgagtgcactattttggatgaacaccaggagctaagagagtaacatagaggtgtggacagaggattaagtcctcaagacaatagccccagccccatgggaaatcatctttctgctcatgattgagaaataatggctcccttggcacttgataacctttcgaagagctttctcctccctactagctggttccagatcactcttcacccagtcacattcctctcactcacttgagctgcccagcctggtctggcactagagacatgcacttggggccctcctcaaaggaagaccctgagatattctgcttacttctactctgctcctgcctgcagggccagctaaaggaacttttcatgttttctttgcaaggaaccctgcctggctggcattttagagacaagcaaaaggggcaataacttccttgctacaaaacagcttcaagtttccatagagtgataagggaaatgagggccaaaagacactgttccccatcctgtggcaggactgggggcttcaggagaaaacttggggaatgtgtaacctctgtgggtttgtagcttaaaaacactgagatcctgggttttctgtctttgttttttgccttttctcttaggaaaggagtgagctagggtgacaaggggcaacattttttatccctcattggctctttctacagaggaaggatcttttcttctaagataatcagcacaagacaatgaagataggcactagctcccagttaggtatactaatggggcaaaaggaagagcatttacatttattgaagattcactaaatgccagatactgtgctaggcaatttacatatggtatagttcatttaatcttcacaatgatcattttgcaggtgagggaactagaactcagaaaaggtacttaatttccccaagattacatagttattaggtgacaccggcaagatttcaacaaagctaatgtcctttctactttactgtgctaccatgatgatggtaatcaaaaatggcagacaacccataaatcttccaactttggaataggtttttgcactgaagtctgaatatggatacgtattgaatgtttattctggatattcacagaatcaaaaaatatgtgtaatgaattatgttgctgaattaactgaaaggaaagtaaaaatgtagcgctttctcattttcttcacgaatttggaattcttttctgctttccactatgcagataacatcagttcagacaaatattaaatacctacctaaattagaatgccttctcctcatgggatttttttaaaatcttgtcatttcatgtctctttaattaaagagttttgatttcagaggagggtacctgcaaaagaaaacaacaaaaaaactaaaggatctgagaaataattagtgtttacttctggggaggggaggaggtctgggatgggggtaaaaaggatagtcttatctattatgtatattcaggtttttgttttttacaagaagcatgtattaggtattatttgtataataaaatataattttaaaaatacaagaaatttctcatataaaaatatgaaagtaatcagactgcaacactcagtgcctgagacagagctacagctatcagggtgtccagacagacagaagattacattttcttccttgctccttgtacagccccagacctgcatgcttcattgaaaagaaaagaagatacctgaattaaatcaatgtgatgcttagtaccctatcagtgcacatttcttttctatttttaaattttaaaaataacacttggccaggcgcagtggctcacgcctataatcccagccctatgggaggccgaggcgggtggatcacctcaggtcaggagttcgagaccagcctggccaacatggtgaaacccctctgtactaaaaatagaaaaatattagccgggcatggtggtggccacctataatccaagctactcagctgaggcagaaaaattgcttgaacccaggaggcagaggttgcagtgagctaagatcatgtcactgtattccagcctgggtgacagagtgagattccatttaaaaaaaaaaaaaaagaaaaaaaaacacttatggcggtattctcagtcattacaaataaataaaaacaatccatatgccctggagaatttgattccaggagtaggtctagaagaacttcaactggagaatggatagagaaatcatggtatatttgcagaatatatattatatatataatagatagcatgtgaataaattaattacaaaaacatatgactacatctattattatatagcatgtagataaattacaaaaacatgtaactacatctatgaatcttagagcataatattgagtaaaaaataaataaataaaaattaaggccagaagataacacatagcacaatgtccttttcataaataaatatattgcttaagcataccttatatatagaagataaagcttaaaaagtaaagaagaggccgggcatggtggctcacgcctgtaatcccagcactttgggaggccaaggtgggcagatcacgaggtcaggagaccgagaccagcctggcccgcatggtgaaacctcgtctctacaaaaaatacaaaaattagctgggcatggtggcacaagcctgtaatcccagctactcgggagtctgaggcaggagaatcgcttgaaccagggagtcggaggtggcggtgagccaagatcacgccactgcactctagcctgggcgacagagtgagactccgtctcaaaaaaaaaaaaaaaaagtaaggaagagactgataagcccgatattcaggacgccagttacctctggtgcaggcagacatacatcattagtaatgtgctagttcttagggtaggtggtaggttcacagatgttcattttacttaattaaatatattttgaaaatttatttaaagctttctgttgtaaaatatatcacagagaaaaccacatgaaacaactataaagcttaacattactataaggtgattacttttgtaaccaccacccaggttaagaagaactttgtcagctccccagaaatgcttcacataccctagcccaataaaacctcctttgcaaatactcttcatagcactatctgatatgccctttatttttaccttttttaaattaaaacaaaactttttagagacagggtcttcctctgtcatccatgctggagtgcagtggcccaaccacagctcactgcagcctccaactcccaggctcaagtgagtctcctgcctcaatctcctgagtagctaggactacaggcatgtaccacccggtctggctaattttttaaacatttttagtgatggggtcttgctatgttacacaggctggcctcaaacgcctcgtctcaagcaatcctcctgccccagcctcccaaagcactgagatcacaggtgtgagccatcactctcagcctgccctttattttttcatgaaagaaattgctgaagaggactaaaagaagttttagtaagcattcaataaatgtatgttctttatagtttccaaatcagcaaatatagacatcctgcatttttaaggagatttatatattttattggacatgctgtaatttatttaaccacttccctgttggtagacattatttccattttcttctgctagattaatgcttgaaaaaaatgtgtgcctcctaaagactgtgatgaaagttgcctctgaataaaactcaaacaaatcattaatcattaactctttccttacttgtatgctctttggatgctctactgtgttatctataaaataaagtttgaagtgaaaaattagggtaaaacattttatatcatttttaaaggatatatacatggatgtacttacatatgcatgtttaaatttatataccataacatttattctttttttaaaaaagtcttatgaattttaacaaatgcatagtcctataactaccaccaccacagtgaacatccaggacagttccatcccttgccaaacaaacaaacaaacaaaaagcttcacccaagtcttaagtccaggcacttactgatctattttctgtccttatagtaatgacttttccagaatgtcatataaatgggatcattcattagatatccttttgtatctggcttctttcacttaacataaagcatttgaaattcattcatattgttgtgtgaatcaataatttatacctgtttgctgttgagtatattctagtgtatgtatactatattttgtttataaattccccaattggggcacatttgggtatttcccattttgggtgattacaaataaagttattataaatatttgcatataggtttttttgggcaaacctaggttttcatttcacttggataaatacctagaagtgggattgctaggtcacatggtaagtgtatggtttattgtgagaaactgccaaacctttccatagtggctgtaccattttttcattcccaccagcaagtatatgagagttctaattgttcctcatccttcccagcactggtattcttttctattttttctttttttttgagacagagtttcgctctgtcacccaggctaaagtgcaatgccgtgatcttggcttactgcaacctccgcctcccgggttcaggctattctcctgcctcagcctcccaagtagctgggattacaggcacccaccaccatgcccttcttttgttttgtatttttaatagagacggggttttgccatattgaccaggctggtcttgaactcctgacctcaggtgatccacccaccttggcctcccaaaatgctgggattacaggcatgagccaccacgccctgctcttttcttaagtcattctaataggtgtgtagaagtggttctaacttgcattttcctaatgactaatgatattaagtatacatatatttatatattattttataatcttatatataatatacata

SEQ ID NO: 90 - DNA, 12869 bp, Homo sapiens
  3rd PDCD1LG2 Enhancer
gacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaaggtgagtggtgtcaaggactagaatccatggaagcatctctccaacagaggatctgcaagtcacagaaacccattaaaggtagctcaagcaaaaacaagcaggctgcttttaaggagacagctatttcagagaaaatgaaagcatctgctcggaaataatttttgacatctgagtacaaagcagccgaagtacaagtgaaagggggtaggacctataggaataaaatgggactggaggaagccaggaaaattagtccctgaaatgtgggagggtatgaaaaataagctttgcctaattcacaattctcccatggaacatccctgacttgattattaagatactctttttcaatagtttataccctgaatccagagtttttaaaaccatggtttgccgcccattcatggattaaaatatcaatttagtgagtagcaaccagatgcacgtttcccgccctttaaaaaataatgtatagaagagaatagacagagtagatcagacgacatcacagagtaggactgagtactgtaaaactaatttctgagggacgtgtgtgtgtgtgtgcgtgttgggtcatggtataaattttttttttcttactttggatcataaaaagttacaagtttggaaaacactgctcaaatgcaagccctatttattgcagatgaagtagctgagatccagagaagggaagtgggtagcccaagagagtcccatgaagtctatagctgtccctattcctctggattcagggatctctccactccagcacaattgaaaatctaaatataaagagaatcttcacactcttgtttgttctagaaaaggtgatttgaggaaagacatataacaactataaaaaatagattttgcttgttcattggcttatggtctccaggcttgaatgctctgagataaatgatgccaatatttctctggcctcttcccctcccacgcattggacctcagatggtctgtactgtcttctagagggtttgtgggttttggccccaaaaaaccattaaccttggcagaaagtgtgtgactttatgatctggtacaaagaaggacaaactagagggactggacatgaggatgaatattgtgttcgcccttatccttgggcaggttattttgcctttcataacctcacattttgcttatttgtagaagacgaacaatagtagtaccaaacacacaggattgttgtcaacattgagagagataatgaacataaagaactgagcatggtacccggcatataataagtgtccagagacttggttaaaagaccctcagttgttacaggggcagtgacctcctcacacctcaaccatcaatgagtcaccaggaaagccattagcctagatgtaactgttttctatctttattgcatttcctacatccaggcagcagctgggaggaactctagaacactgaagtttgtctgagttcccttaatgtaaggctgtacattctcaggatgccttgatgtactcgaatatctgcaaccctaaatcaccacctctgtttttattgatctctatctgaatgctgtattaatgggccaggccttctgcccattctctcaaactgagaactgtctctcattcctggggaggcaccctgcctactccttacctagatcagggatttctcagttgtggagagatttgttccttatagtgttggtcatcaaactgggatatttggggattacaaagacttttcaagggatgtatgggcacaggcagttttaggaagtgagttcctagatcctcatcttccccaaatactcgttcccaaaattgacgagcctgacaatgtgcatgccaggcaaggctcttggggttcccctaaaacacttcctcttttaagcctaccactcactcatcatgaatatagtccattgtcccagggtgtaaaaccctctatagtgttaaataaaagaatgattgggaacattgacacctgatggaactgttatgactaaaaacccttttgcaaataatgtggtatctaattttctgctttcaacaaaattgaaggaggcccttataaagttaataactgataatcaaaaatgagtaatttttgccatgtaaatcaggtcaaagaatgaaatggcattgctgtaacgaaactgcttccattcccattgatttactcatacgaacaagattccttagcctttataagctacaaaaaaatgaaaaatagaaatagaattgaggctgaattctattatataaaatcattccaaccatgtcatatggttcttcggattcatgaataatttggaaaagagagccatatccatcttattaagggacacattcccaataaattttcatctttcatgtttaataattatcaatattcataacattttacattttgatcaaatatgtgttaataataatagaaataaatgtccaacaacgatagactggattaagaaaatgtggcacgtatacaccatagaatactatgcagccataaaaaatgatgagttcatgtccttcgtagggacatggatgaagctggaaaccatcattctcagcaaactatcccaaggacaaaaaaccaaacaccgcatgttctcactcataggtgggaattgaacaatgagaacacatggacacagggaggggaacatcacacactggggactgttgtgtggtcgggggaggggagagggatagcattaggagatatacctaatgtttaatgacaagttaatgggtgcagcacaccaatatggcacatgtatacatatgtaacaaacctgcacgttgtgcacatgtaccctaaaacttactgttaaaaaaaaaaattagatcttaatgcagaacaccctgaacatttaaagcttcatagtcacaagagaaaagttttcatttcaatagctataaatattttgttgttgtaaagacatataacgataatcaatacaaaatctgtcaaacaaaaatatgttacattaagataaaattctgtagggaaggtgaaattggaagtgagtttcaatgaatgaaaagaaacaatttagacagagaagaattttttcatttaataatttatttatttttacttagaaggaattgaatagattaggttccttacccaaaaagcctctgttatttgtcttatttatttattctcttttttccacattctccagtctcattccccttttttaacacaggaaattattccagcatgtttcatacatattcttttgtttgtaagagcttatttaaaatatgtaatattgttttagatgcatatattttttttcttgtggaaactatattgtactatatatatatattttagaaatggacacattaggccgggcgcggtggctcacgaccgtaatcccagcactttgggaggccaaggcgggtggatcatgaggtcaggagatcgagaccatcctggctaacatggtgaaaccctgtctctactaaaaaatacaacaaaaattagccgggcgcggtggcgggcgcctgtagtcccagctactggggaggctgaggcaggagaatggcgttaagccgggaggcggagcttgtagtgagccgagatcgctccactgcactccagcctgggcgacagagcgagactctgtctcaaaaaaagaaaaaaaaaaaaaagaaattgacacattaagtttattgtgaaaacatgattacaagcaataacagatataacagcagaaaaaattgtgaagttatgtgcaccttcttttgagatcatttttttgggtatatgtgaatgtattttatctttttttaattgacaataattgtacttatttatgggatacatagtgatgtttcaatatatacaatgtatagtgatcagatcggggtaattagcatatttatcatctcaaatatttattatttctttgtgttgagaacattcaatgtaccccttctggctatttgaagctatatactgttgttaaatatttatatgtatttttcaaggataatgttgtatataaaagataacttcttttatatttagtcacctttggatacatatgtaagagtaaaataattgttttactaaaaaaattcataagatgctgaacattatatgtttttccagtatagaaacttatgaaaaattataagaatcaacttaataggtgagaagagcatactgcatcatacttattttaggaggaatacaagcaaaaaaaaagttggaccatcacctaagagtaggctaccctgatccagggtctctaaaagaagcaagatagatctgaggccccaatgagggttcccatgaatgaagtaggactagaagaaggacatgtttttatcttaaagtgcctgatccatggcataaagcttgaaaatgggtttgtttatagcaccttcgttgatgtctgggcagaaattcttatcaaatataatgaaaagagttaatttcaaaaggacagaacaaattatgaggtggaatgaccggagattctggaagagacagtgataaaggactgtggtttctgaaaagccaggtggcacctacatttctgggggcaatccatctgaggaaggggcgggagcatggccaaagaacagagaggccccaggagcccaggggtctctcagaggagctggggttgagaactggtctgtgcaaaggtttccagacagggttgcagaggaggcactaaaaacaagaacaccaagagccaaaccatcctgaaggcctgggcagggcagggggatgggaagagccaacaccaggaatgggctgaagctgacagaagtacttcaaaccagaaacaatgaatttaaactatgccctaccacaaatagacttaacagatatttacagaacattctacccaacaatcgcagaatatacattctattcatcagcatatggaacattctccaagatagactatatagtaggccacaaaacaagtctccataaatttaagaaaatcaaaattatatcaagtactctcttagatcacagtggagtaaaactggaaataaactccaaaaggaaccttcaaaaccatgcaattacatggaagttaaataatgagtgatcattgggtgaacaatgaaatcaagatagaaatttaaaaactctttgaactgaacgataatagtgacacaacctatcaaaactctgggatacagcaaaagcagtgctaagagaaacattcatagcattaaatgcctacatcaaaaagtctgaaagagcacaaataggcaatctaaggtcacacctcctggagctggagaaacaagaacaatccaaacccaaacccagcagaagaaaagaaattacaaagatcagggcagaactaaatgaaattgaaacaaaaaaaatacaaaagagaaatgaaacaaaaatctggttatttgaaaagataaataaaattgataaccaagaaaagaagagagaagatccaaataatctcaattagaaatgaaatggagatattactactcatatcacagaaatacaaaagattattcaaggccactatgaacacctttacacgtacaaactagaaaagctagaggagatggatacattcctggaaatatacaacccttcgattaaaccagaaagatataggaactataaacagatcaataacaagcagcaagattgaatggtaacttttaaaattgtcaacaaaaaaaaatccaggaccagacagattcatagctgaattctatcagacattcaaagaagaattggtaccaattctattgacactattccatgggatagagaaagagggaatcctccctaaatcattctatgaagccagtagcaccctaatacaaaaaccagggaaggacataacaaaaaaagaaaactacaggccagtatccctgatgaacatagatgtaaaaatcctcaacaaaatactagctaaccaaatccaacagcatatcaaaaagataatccaccatgatcaagtgggttttacaccagggatgcagggatggtttaacatccacaagttaataaatgtgatacaccacacaaacagaattaaaaacaaaaatcacatgatcatctcaatagattcagaaaaagcatttgacaaaatctaacatcctttatgattaaaaccctcagcaaaattagcacagaaggaacatatcttaaggtaataaaagctaactacgacaaacccacagccaacattatgctgaatggggaaaagttgaaagcattttccctgagaattggaacaagacaagacactttcaccacttttattcagcatagtactggaagtcctggccagagcactcaaagagaaagaaataaagggcatccaaattggtaaagaggaagtcaaactgttgctgtttgctgatgatatgatcatatacctagaaaaccctaaggattcatcttgaaagctcctagaactggtaaacaaattcagcaaagtttcaggatacaaaattaatgtacacaaatcagtagctctgctatacaccaacatcaaccaatagctgcaaaaataaaataaaatacttaggaatatacctaacgaaggacatgaaagacctctacaaggaaaactacaaatcactactgaaagaaatcacagatgacacaaacaaatggaaacacatcccatgttcatgaataggtacaatcaatattgtgaaaatgaccatactttgtagattgcaaaagcaatctacaaagtcaatgcaatccccatcaaaatactaccatcattcttcacaaaagtagaaaaagaaatcctaaaattcatatggaaccaaaaaagagcccacatagccaaagcaaggaagactaagcaaaaagaacaaacctggaggcatcacattgcctaacttcaaaccatactataacaccatagtcaccaaaacagcataatactagtataaaaataggcacatagaccaatggaacaaaacggagaacctaggaataaagccaaatacttatagccaactgatctttgacaaagcaaacaaaaacataaagtggggaaagtacatcctattcaacaaacggtgctgggataattggctagccacatggagaagaataaactggatcctcatatcttaccttataaaaaatcaactcaagatggatcaaagacttaaatctaagacctgaaaccataacgattctagaagataacatcgaaaaagcccttctagacattagcttaggcaaagacttcgtgaccaagaacccaaaagcaaatgcaacaaagacaaaggtaaatagataaatagggacttaattaaactaaaaagcttctgcacagcaaaagaaataatcagcagagttaacagacaacccacagagtgggagaaaatcttcacaatctatacatctgacaaaggactaatatccagaatctacaaggtatgcaaataaatcagcaagaaaaaaacaaacgatcccatcaaaaaatgggctaaggacatgaatagacaattctcacaaggagatacacaaatgaccaacgagcatatggaaaaatgctcaacatcactaattctcagggaaatgcaaatcaaaaccacactgcgataccaccttactcctgcaagaatggccataacaaaaaaataatagatgttggcatggatgtggtgaaaagaaacactcttacactgttggtgggaatgtaaactagtacaaccactatggaaaacagtgtggagattcctttaaaaactaaaagtagatctaccatttgatccagcaatcccactactaggtatttacccaaaggaaaagaagtcattatacaaaaaaaagatacttgcacacgcatttttatagcagcacaatttgcaattgcaaatatatggaaccagcccaaatgcccatcaatcagtgagtggataaagaaaatgtggtatatatattatacatacatatatatatgcatattatatatatacaccatggaatactacttagctatgaaaaggaatgaaatcatagcatttgcagcatcctggatggaattagagactattattctaagtgaagtaactcaggaatgtaaaaccaaacattgtatgctctcactcataagtgcgagctaagctatgaggatggaaaggcataagaatgatacaatggactttcaggacttaggggaaaggatggttgggggtgagagataaaaaactccacatttgggccaggcgtggttgctcacacctgtaatcccagcactttgggaggccgaggtgggcagatcacgaggtcaggagatcaagatcatcctggctaacacggtgaaaccccgtctctactaaaaatacaaaaaattagccgggcgtggtggcaggcacctgcagtcgcagctactcgggaggctgaggcaggagaatggcaggaacctgggaggcggattttgcaatgagcagaggtcgcaccactgcactccagcctgggcgacagagcgagactccgtctcaaaaaaaaaaaaaaaaaaaaaatggccttcaccctaagaaggaagaaaccaagggcagaggaaggaaacaatcaaagagaagcaaggcagcagtgaaaagacaactgtacgtttaagcctctaaggcccaaggaaagcatttgctaaaagagccaagtctcagtgtctttttttcccttggggaaacagaagggtgtaagaaaatcggagtcaagaaaatgtcctgagctccgcctgcagtagcgggaagcctaggagtaaaataacacgttttttaaaaataaagaaagaaattattttaaaaaagaaaacaatgtcctgaatttcaatggggtgggggggaggggaagctcctggggattacaaactcgttaacctgctattccttttcaggcaatttaacagatgaattgaaagcagtcctaaaagatttaactgattactagaaacttgcatagatcctctaagaccaaggcatgtaaaactacatttttccatttatttactgtcattatgactataaaacagatactaccatgtatacatttcatctttatttcagaaattacagcattgcttgtaacatatctgtcagacagccagaacaaaccagggaaacagaaaccatttaaacctgtggaaatctaaagctgaaactagtaattcttttaatgagggagactgagaagccaaacagagaacagggaagcaattcagaaattagcaatagcagaaagctgctcctaccactaggctatagtgaaaagggggaaggcagggttaatggagcccagggattaaagtcacttgacagacactggaacccagtgggcctgtccattggtatctggagccagggaagagatacatcttctgctggagaggccacaaaagtatagagcataggggagaaataccttcccttctccctccagtccaccctctagtgttcctgtcttgcttcctattggctgtcacgttcctaggctatacaggccacaggagtctgccttcctgcaacacagagcagagaagaaaaagtgagagatggatctgaaggcaaacagacccaggacacacaaagcacacacaccttgtgtattgggtggtaaaaggtgggataataatacagttgactagatctataacagactgaaaagctagtagttgttgagtcagggacaacgaaggctggctgatggcctcagtcaacttggagacaatctccaagtgctaaggggtctgttattcaggttgtaaggatatagccaacctaactgagcagcagatcatatatttagcaaaactgatcttatgaccttaggttacattaaaaccctggatatttgtgctgcttagataatatctagaatatagattgtgttacatatcctttttaaagaacgtggcaaaactaaactataaccaaagactactatctggaaatgggtctgaagactgtatcttgtgagatatagttaaaggaggtaggcatgttttacttagggttgaaaagactagatggagtcttcccagttatattcaaatatcagaagggttacctgcaataattgctaacactaattgagtgtttactacgttctagacatctaactaattatttaacacccttgttaaggataagtattgctgtatccatttcctaaacaagaaaactgagggtttaagaggtcatataactagcccttggctaaagcctactcaaactgctcagattctgaactcatgtttttaactacggtgcttaccatatgttgtgttactaaactagacaaataccaatgggtagaagctacaaagaggcacaattttgcttggcatgaagaaaatctttccaatggaagtttaacttgcttattgtataatcatggcaaagactgcttctagaggaagtaggagtttccattcatagatgttttcaggcaaaagttatttagcagtttactaatatcagaagaaaaatattactaaagataacaagggacacttcataatgataaaagagtgagttctaaaggaacacataacaatcctaaatgtgtgtccatttaacagtatagcttcaaaatattaaacaacaattggcagacttaggagaaccagtcaaatccacaattacatttgagatttcaactcatctctattacaactgatagaacaaacaattaagaaaatagaaaatctgaacaacacaattagccatcttgacctaatagacatatgatatatagaacatacacccagcaactacagaacacacattgttttcaagcgtatgtggaacaatcatcaaagcaattatctaggagaattgctgtagaaggtgtttttcattgagcaataagtcagatgacttgaatttttggagtacttccgcctcttaaattctaaaatttactcatcttttcctaagaatatcaccctcagtccagcttccccactgtgggaagcgattccttttccaccaccttccaaataagaaagaggctgtggagacatttctgatactgcaaaaatgtaggatgtgggctcctgtcccttccccaaaccttgctgattcttgtagtggaagagctctctctctgtctccctatctgctccctcatgtatcccaagtcaaagcctcagccaagctcccaattcctggcatccctacttctgaaatcacttctcaaccaggacaccaagatcagtttcttggtccaagccacctgcaatagtgggctggaccctcacccacagtactctgctcctgttcttgttctacttcattccccaaaagacttgagagcttacagaaataatctacagtatgatcatataaaatgattacaaaagacattgaaccaagggaaaataagtgtagataaataatacaaaatgagagataaagtgagtactcgaaatacacacttcgggtactgtttgattatgaaagataggccaaagttttggcttcaaggagattggtgagtctaacaggtcaagtccttcagtaggctgcttcagtgtctgaattgccttatcttctactactgctgggtgctcctaagaacctcagagcatattcctctatctgcttatgttgcaccatccctagacatctgcaattacacagagacacatcctcttatggtgattccaattaagaatgcattacaaaatagtaatatgaattttacccacctcatagggtctgcatatcatttaaatgacataatgtattatatgtattatgtatatttatacattagggggaaagatgtcagagctttttgggacataccaggaggcccagctgggtgtgctgaccacatggagacgagaacttcaagggagagccaaagtgcacgcaggttctggtggatgtttcattgtgcagtgaccctgctctctagtgaacccagatctagtgggtgttgtttgctataatgaatcaaattgtcaactcttaacattgagacccacaacacaggaggggaacagaggggcaaaaattgtgaagaacggcatgaacattccttctcttccataggatgtaaaaggacgtggcacaaagctcaacacatagaaaacaataagtaaatcatacacatcagatggttttcacatggttgttaccattattttaatgtgaaattgtttttcacaaagtttgtacctatttatacttccaacaatttaggagaaaaaagttgtatcacacctctgcctttacttcaagactacacttacttcaaaaattgtattgaaatttaatttcttaaaagaatatttcctaccgaatggaagccagtgctcatcccctcttcctctcaccaaatatcaacaggtgactttccacactgcctggtaactgcatatggtattgatatttgtttatttttagctattatctaagaccactggaaggtttgttcttgtgtcttctagtctcttggaatatcatgcctattttacttatttttaaagtttttataaggttgtaatgttttattttaattttaaaatttatttttaactggcaataatgtatatttatggggtacaatatgatgttttgatctatgtatagattatagaaagagtcaatcaagccgggcacagtggctcatgcctgtaatcccagca

SEQ ID NO: 91 - DNA, 8233 bp, Homo sapiens
  4th PDCD1LG2 Enhancer
gaatttaataataataattaatttcactcttttccagggaagtgctataggagtgtaggtggcgtgtgggttctggcatcagagattcaaaccccagctcaactaggtatgagttatacaactctgaatatattggttgacctctacgcatcagtttacttcaatatagtgagacctggccaggcgtggtggctcatgcctgtaatcctagaactttgggaggtcaaggtgggtgaatcacttaaagccagaagttcgagaccaccctggccaacatggtgaaatcccatctttactaaaaatacaaaaattagctggggatggtggcacgcacctgtaatcacagctactcaggagactgaggcaggagaatcgcttgaatctaggaggtggtggttgcagtgagccgagatcacaccactgcactccagcctgggcgacacagccagactttgtctcaaaaaaaaaacaaaaacaaaaacaacaacaaaaaatgcatatatatatatatatatatataaatagatatagtgatatagtgataccccatctctgcaaaaaatttaaaaaataaaaataaaaaaaatttaaaggggccgggtgcagtggctcacacctgtaatcctaacactttgggaggccaaggcgggtggatcatgaggtcaggagttcaagaccagtctggcgaagatggtgaaaccctgtctctactaaaaatacaaaaattagccaagagtggcggcgggtgcctgtaattccagctactcaggaggctgaggcaggagaatcatgtggacccgggaggcagaggttgcagttgcagtgagctgaggtcatgctactgcactctagcctgggcaacagggcaagactctgtctcaaaaaaaaaaaaaagaaaaaaaagaaaagaaaagataaagaaagcagttatctttctcagtttatcatgaggattttgagcacaggttttgtcatccccttagactcctagagagcagggaaggagtgagatttttgccatgtacctggtacgtgataggtacctcatgcatggtcacctctgagactcattatgtattgggagaatggctactattaagacttctactttttttttttttttttgagatggacttttgctcttgttgcccaggctggagtgcaatggcacaatcttggcccacagcaacctccgccccccaccaggttcaagtgattctcctgcctcagactcctgagtagctgggattacaggcatgcaccaccacgcccagctaattttgtatttttagtagaggtggggtttctccatgttggtcagggtggtctcaaactcccgacctcaggtgatccgcccgcctcagcctcccaaagtgctaggattacaggcgtgaaccaccgcacccagccaacacctttactttttatggcctggatataatgggctaaaacatatataatgacaatgcttaaaagacttagatgaattctaagtctggaaaaaaaagtactttttacaaaaggagcaaaaatagcattcaggagagtttgaggaattgagaaagaccaaacaaacaaaaatcacctatgatctcatcatccaagcacaaacactttcatgtttgctgtttgtttctgctctttgtccatttatgtatttaagtttggctatggttgcaacatgtaattttctatactttaaaaaatttggggctgggcacagtcgctcacgcctgtaatcccagcaccttgggaggccgaggcgggcggatcacctgaggtggggagttcaagaccagcttgaccaacatggagaaaccccgtctctactaaaaatacaaaattagctgggcatggtggtgcatgcctataatcccagctactcaggaggctgaagcaggataatggcttgaacccaggaggcggaggttgcagtgagccgagacagcaccattgcactccagcctgggtgacaagagcgaaactccatctcaaaaaaaaaaaaaaaaattgtcatctaccataagctcacacttatgttgctgacaagtgttcctaattatcacttttactggctgcataatattctactgagtggctgtgacaaaatttaattaactgttcccctattaatgtaagattaccgttgtttctggtttttttgccactttagttacaagcttttgtgctggatatcctccatttgaccctccagatccactctccagccttgtcctccctgctttgggtcctatgaagctgacttgtatggactgtatcaatgggctccattgctctctggcttttgattgggttcagccaatggggaccctggcaggagatcagaggatgggagaagagtattgctggggtatttattccccaggctctccgtctccagggtcactgctggctggataattctctcaactaaaggtcacagctcttgttgaatgaccctttccacatggctccatctgcctgtgggttccagtaactgctctctccagtccccttttcatgtctgggtgcctacgtgtcccctcaccccctgcaacacacacacacatgtgcaaacacacacacacacacacacacacctgttcctgctagcctttgggtactgcactattccttagagttccctacacctggcccacatctctacaaagagtctctttaattagtcctcaaattatacagttcagtgtcctaactgatatatcatgctatttcagataatgcatgtctttttacatctaatttcattaggatggatacctgaaaagggaattatggagtcaaagaatgtgaacacttcaggctcttgagtcatactgtcaatttgcttttgaaaaggatctgttggcattggtaccagtgcatccttccagcactggatattttaaaatataattttgctaagtcaataggttaaaaaatggtactttatggtaatttaagttttcatatcttggattaccctcaagtttgcttataaaacctggttattgctgtgtacgttgttattttggagtttgtttaaatgtttctcccttccccactcattctctagttgtataatctttccttaataattcaattttttaaaagatcaactttttaaagcctcaatgtcttcatctatttacagatatcctaacaataacacctctctcacagaattattgtgagaattaaatgaaaataagcatgtagcatataagaaacatccaagaaacatgaatgctttcctccttaataattatgcatggagtttaattaacaaattatgtctattttttaaaaaaattgtgtcagttttctttcaagtttatattgaaacttacttcataaaataatattatagatgagcagaacaattcagtattatccagatttgtttttatatattatgtgactttagaaaatttgtaacccttttaagccaaaatctttaaaaactatttattttattttattttattttattattttattttattttgagacagggtctcactctgtctcccaggctggagtgcagtggtacaatcatggctcactgtagccttgacctcccaggctcaagtgattctcccacctcagcttcctgagtagctgggactataggcacatatcaccatgcatgtgttacctcaggtctggtttctattatacagatcaagtaatgctttggcaggctacacatctattatctatttaattctttttttgtgtgtgtgtgtgacggagtttcactcttgttgcccaggctggagtgcaatggcacaatctcagctcactgcaacctccgcctcccgggttcaagcgattctcctgcctcagcctcctgagtagctaggattacaggcatgtgccaccatacaaaaataattttgtatttttagtagaggcggggtttctccatgttggtcaggctggtcttgaactcccaaccttgggtgatccacccacctcagcctcccaaagtgctgggatttcaagcatgagccaccacgcccggcccacatctatttaattcttagagccaaccaccaccaaagattattcctgctggtaaaaaatgctgatcgctactctgggatctcatcatctacattgagatcaggcagattttcccaccacatccttggcctatagaaagcagctgcctgaacatgttcaagggtgctggggcttctcccattaaagcatttttcaatgctttagagaagaaactattccttaggctctttcaggaccaagtgtggtgagggaagaggcacagttacatataataaatcactcctttatttctatctccttagagattctaatggcttaggccattagaatccttcctatacattattccagagaaattctggcaactcaacaccattaaatgtaacctaccagtgagtccaaatttcagccaatcaactaagcaaatagtgccattcacagctgctctagctaatacatttgtttcagctagcttttgttgtataacaaactatccaaaacttagtgacttaaaacaactgtttatgtttttatgattttataggataacaatttgggctgggctcagtggaggcaactcatttgtgctctacgtggtgtcagtgggatcattcatgcatttgcagtcagttggcagtttggctgccagatggctggtctcagatggcttcattcatatcttcctattggtgctggctgttggtaaaaccacgtatcttcagtaggttagtccaggcatcttcaacatagagtctaatccaaaaacagcaaaaaagaaagaaaaccccaatgtgcaagtgctttccaagtctctgtttgtatcacatttgctaataatgttccattatccaaagcaagcacataaccatgccaaaaatcaatgtgtaaaggaattacatgaaggcgtgataccactactgtaatcatctacaacattaagtccaaaactatctggaaagtgtagtatatcaggactaccttaatttggccccagttcaatgttatcttctgtgctcctgggtctaatacctttagaattcatccccatacatactagcctggtttcctctaatgttaagttaacaaaatcttatgattcttttgaagtataagacttttcctgctgagctagactctgctcttcccacctccgtatattccgggaactgactctaaataaaggccatgagagttgggagcactggggctgagaaagaatagggatctcccttgcaaggcaagtgcctcatatgggcttattacaggctttcaaacaaggaaaggctaatatcattagacaagaaatgagaggcttcttccactatcaagggaaactcagggatgcttgggggtttcaacattctcagtttcatccaaatccaccaaaatgtccccattcctagtctcagagtcctactcctttcaaattactgagaaaactttcacatatgagacttagccagtctgtgaatgattgatttgggttgaatttttcagtcatgtctttcatgtctagtgattcctgtaattagaaggaataagaggtactttcagggcagtcttagaagccctctggtgctctgaatatgatttgaggtgaaagccctaaacttgttagtttcttcctgtaagcaccctggtgcaatcagaagcagccatcccacattacattccttataatcatctttactaccataatggttaaatgcaacagctacttggcctccagaaacttgcctttcattggtattcaaccctagcaagaacagatgataatttaatcaaccatgatgtcaatgcatgccatagattactagtggcaaagagttcagctctcaattcaaaccaatccaacactaacaacaaatcaaatcaatcccagaatgtcagaatttgagaatctgtttcctatgaccacacctagtatcaagtgctagtatcagccagagtccagtcataaaaatagagtgtatttaatattaggaacttgtaataaagatataagaagactgaaagagcaaaaaagtggatgccaaatattagaactacagacagcagctacctttctactacctattgctacaggcatgacacattcaggaactagaaacaggaaataattccccctcccaccttccagtccccaaggccttcccatttactgaacttaacaggaagctagctggcaagggaggctggcaaatgaagtttgtcaaaattccagccctggcacatcagagcagaggagaggaggatggacttagagttgagaacaggaggtacataaccaactcactcctcaatcaaaatctatctggatgaagtggagacatatccattaagagataaaaaataaagagactataaattccaattagattgtagcacaaggaattgtcttaaactctgtggcatctgaccctgtaacaagggcccaatgtatatttgttgattggttttatgagaaaaataaaaattgggcatctgctttgaccatgagcataggacaaaataaacttatttatttatttatttatttatttatttatttatttatttatttatttttgagacggagtctcactctgtcgcccaggctggagtgcagtggcaagatctcggctcactactagctccgcctcccaggttcatgccattctcccgcctcagcctcccaagtagctaggactacaggtgtgcgccgccatgcccggctaattttttgtatttttagtagagacggggtttcaccgtgttagccaggatggtctcaatctcctgacctcgtgatctgcccacctcagcctcccaaagtgctgggattacaggcgtgagccaccgcacccgggcctttaagtacattttgtagaagttgtatcaaaattcattggctgcaaatgagagaaaacctgatgcaaactggcttaaatttttaaaagataatgtgttggcttatgtaactgagcagccaaatgtgcaactgggtatagggggtctaacaaatgtcttcaggattcaaattgtctctatcatttcttcactctgtttcctttttgttgatgccattctcagacaagatatctcctcataattacaagatggatgccaatgattattaaacctttcagattcaaatattttacaagaaaaaaaagccagagtatttttctcagcattctcagcaaaatcctgagatttacagtggaaaacttatgtgctgtgccctctccagaaccagtcactgaaagaaagagtatgtaagtgatatcttacatctggagctccacccagaccacatgaactgaaagtggagagtgaatcaaagtgacatcttttgtgctaagatgttgcaattgcccaaatgcatctgtggacttctactagaaggtatagcagaaggtgttaggtgtctattataagaaaaatatcactatcatataacacccctgggggacatatttctaaatttcagacaaaatatattttcagtgcgttgtctttcctgataatgtatttacagcctgtcatgggatatgtctgttttaaagtgctgggcagggtttggactacatgttcctccttgtgctgggtttgaaacattagattgccaatgtctcattgctggtatccaaaatgaggtttaattaagtttgccattatagctaatctccataccatgcaccagacattgctctaatagcttcacatgtatgatctcatttaaacttcataacttagtgtattgtcttgtctattttacacgtgtattagtccgttcttgcattgctataaagaactacctaagactgggtaatttataaagaaaagagattttattgactcacagttccacaggctatacaggaagcaaggctggggaagcctcaggaaacttacaatcatggcagaaggtgcaggagaagcaggcaggtcttacatggcctgagaaaggaagagggagagcagggggaggtgctacacacttttaaacaaccagatctcataagaactcactcattatcatgagaacagaaaagggaaattccactcccatgatccaatcacctcccaccaggcccctcctccaacactgggcatcacaattcgacatgagatttgggcggggacacaaatccaaaccgtatcaacatgtaagcaaactaaggcccagtgaagttagataaattgctcacatcacacagct

SEQ ID NO: 92 - DNA, 24830 bp, Homo sapiens
  Coding Sequence of the ICOS Gene
cgagagcctgaattcactgtcagctttgaacactgaacgcgaggactgttaactgtttctggcaaacatgaagtcaggcctctggtatttctttctcttctgcttgcgcattaaagttttaacaggtaagtggtgtattgaatatttcttattaagttataattcaagtaaacattaagaaaaagcaaaggtagaaaaattacgcacccaaaagacagtggttttggtttttgaaagtaggaatagtttcaggatatggccaagggcaccatgtcactcatgtcactgtggatggcattgagtttgcattgctgcctttgatactgtgtcttgagatgaaaaacatgtttcatcagaccattaaatttttaaattacctgcttggagttacctgtcagtggataaactagcagagtggcttactgttcttagagaaagatgaaaggcaaaatgacttgtgtcaacagaatgaaaattaaatagctctggcatttggactgggaattctttctgtggtagaaaataaaatgggaagtctttgaaaagaaggattttgattttaatcttacctggatgatctgttatctgaaatgtccagggcaccatagagtttttattgacactaagtatcagagttcaccctaaaaagccaaggaggaaaggataatgtaaaaatacttcctagcccctgtagaccttacaaaaaagatcattctggagtccctgattccttctcttgaatggcatatagcagactctatatggacaatttaaataatgctacatacaatgtaagttaatacacgtgtttctgctgctttttactgtatataatttgtactacttttgttttctctttcacactgagccctattcttgaggttgaaaaaaggaaagttaagtaatattaaataacttaaataatcaaataaactaaaagtgaaggcagaacttttagtaggtatgatcctatctagggatacattttttcagtggcaaaaaaatagaccttactgttcttacaaaaaatgaaaaaaaaatgaaatcaaattgatcaaatgtttcatcttgtgctggctcaaagtgagttaagtgcagttaagaggattgaggaatgtagaatgagcacaaggacagttttgggctacttgctggtttatgccttttctagaatctcatgaagtcctttagcggcatgaatgacatgagcagctttggaatttatattcattcttcattcatccatttactcatgtagcattgagcacctgcctggtagcaggtactgtgccagatggtgtatgtacaaggatgagcaaaaccaggtcaacccctgttctttggaaggtaactgcatggtagagagagatatattaatcaaataatcccattgattaatgataattacaggcaaaactcaattatatgagggaatgtaacaaggagcttgactagactgggtgggtgtggaggtgtagctgaggagcagggttcattgaagtctttcctgtgcaagtggcacttgagcggagatttcaaggacaaggtagcaatcaatggggagaacggtatgaaggtagggaagaacgttccataccatggaaggaacaagtgcaaagagcctgtggcaggaaggaatgaggtaaggttagggaactagaagaaagcagacagatgtgcctgagcacaaagagggaagaggctgagcttggtccaagatgaccaactggtccaagttggtccaaggtgaggctggaaaggaaagtagaggccagaccattcagaccatatagtctatgttccagattttggatattcttccaagaacgttggtaccattcgtggaagggtttgtttgtattgataaaaatcattcaactaggccaaaccaatttgggcagttctggttgtggtattatgctcaggagaattaaagtagcatcggtgtcaattctgtggaaggtgagatccagccttaggtaggattgttttaagtttccagattaagctgacgaataatttgtattctggaacaatattcatcgtagattctaaatgaatacaaccaatgttcactctcattataaagaaagccatgagatgtggcatgctgtttggcatgtggcaaacctgaggcacgagtggctaaatggtaacaataaatctgctagcaatgatcctatttaaaatatctccacaatgcatgtatccagaaactgccatgtaaaagctctaaagaaaaagagccaaactcaagtaaactaagtacttgcttgtcctctgttgtattttcaatcctcccaatttacataggctttctcatgccatgaagatgtaggcattcttacctttagtcagtgtttgaagaatttccaaccaggaaaggttaagtgatttgttacacagtagttggtggcagaaccaaagttagaactctaatgtgactccaacatctacattctttctaaactgtgttgaagtagtggaggtgtaacataaatctaaaggaacgtaaatctcaatgattctgatcacctttgttatttggttgtgaattaagaaggatgggaatcttgctgatttctagtctttgatggatctcaatgtagaatttaacaaagtcttgtttttttttaatgaacttggagcaataggacacttttaattataaaaatatctacgaaaaatgtgaatgtctaactacattttgaagaccctctttgtagaccttataggcaacagggaccatatgagtgatgggacaaattctggttttagaaagactactttaaaagcagtgtggataatacaccagattgggaagggctgatggcagagggtgtctaataaacgtgcatgtattatgatgtgttctgtgaggaagctgggaggatagccctcaaggccactttgagccttcctttgtcactgaggcattccattagtgactcctgaattccacttgggaaaagagcccctcagtgtctccagcgtctgagagaagtctgtgaagatgactgaccttggagcccctcttagcctctccacgactgagtaaatgtcatctcctgacagcacccccttccagagtgttcttgttagatttaacaaaaatcccagttgtcaattttttcttttgatagatgaattcaggccattcccagtcagcataagcctctacttgattttatttctatgtttatttactacttatttttctttgttgtatcctctttttctcttttatttttgttggtgtgatgaaatttcttttgactctcctctttgcctccggttaatttggaaggtcgactacagttcttaatttactaagtaattgacatgttcaaagaatcttaattgaatgtctacttgtttatcattgtatgaaaataatgaaaatgcctttgtctgatgtgcctagtccccatcccctgcactgatatgagaacttaagaatgttcttcctttcccactctcacacttcccccagacagtgcaccctgctccatacgtgggttttgtggaaataatttaaaacttacagttgcagatcattgctaggtttcctcttacagtatttctcttctgtttcaagaatcctttcttaacacttacatcacatacgttcaatgacaacatcattctggacatctgctcctgtcttgtgatctctgttctaatctaatgatcagaagacttctcttattttcgttaaatacccccaactctctgaattccagtacaggtaagggtgtcttccttttaccttgatgagtgactgatatctttcctgggaataggagtcctggatggcagcctttcttcttagtggttgcagatattcctccactgtctgctggcttctagggttgtgggtgaagagtttgatggtagtctaactctcattcctttgtaaaaaaaaaaaaaactctagaatttcataatcttgaaagctatttacttcagtattggaattcaggaattcctccaggatatgtgtaactctctccctctgtttctctttctgtgtgtttctattaattttttttttgaggcggagtctcactctgtcgcccaggctggagtgcagtggcgcaatctcggcttactgcaacctccacctcccgggttgaagcgattctcctgcctcagcctcccaagtaggtgagactacaggcacccgccaccacgcctggctaatttttttgtatttttcgtagagacggggtttcaccgtgttagccaggatggtctcaatttcctgacctcgtgatccgcccacctccgcctccgcctccgcctcccaaagtgctgggattacaggcgtgagccaccgcgccccgctgttctattaatttattattattttttttaagactgggtgaaagttttcaatctctagactcaagctttattcttcatttcagtcatttttttcctagtatttgtttaatcataccttatgctgtttttccccactctttctagaaatgtctcttattcttatgtaagatcttgagtcccttattttttcatcatttgtgaacaaaatggctttcacaacttgctgttgcttgttaaccacaactccttcagatgaaatggatatttcagttttaagttactagtagcatattcccatttcttggtagaaacaaaatgcaggcatgtaggggggactgaaattcttatatttactcactgtaagattcatagcattatttggcttaaaaaaattcatcccagtattcacagttgtaaacagcaaaatctacaacatatactgcttccctactctaagaatattgagttttatatgcaaaatgacttactgggctttgcaaatttttaaaaatgagttttaaaatcatttgtagcttgcaataactgaagaaaagatcacaatttctctgtaaatggcatctcagtactactgctgttctaataaactaggtctgtcaaatggcactttttggtcattcaaagtgaaaaaaacatggcatttgaaaccttataaaaattcacaattatattttggaaagtggaacttaagtatgtaggggatatgtcacacaaattgaaagtgttagtcaagaaatgattttttttttcaatagtttggcctgtaaggttgaccaaaacaggtaaagatttgcaagtttagagagtcagaaactggggatatgaacttccttctggttcatgtataacataatgatgcttgtatctactttgcttgaggaaaaaaaagaaacacgttgtccccaaatagggtgatagaccaggagtttccatccagttgaccacgagtgttgttaggatctgtttatttgagtcatgttgacacagacacagcactttcaataagcaattaatgatcatttaaaggtaacttttttgaatttgataaatagattttttttacagcctgtatttgtgttcttctaggactttgcaacaaagaatctgtacatgcaaaaacaacaataacaacaacaagctgtctactgcactcacagttaaagttctgtttactttgcactatctaggactaatgcaaaaatctcatagatgtgcctatttgcacttatttaattatgatgaaatttacttctatatgtgaatccatttctgtacatttctacaggcagataagtgatgggaaaatcattaagaatttagacttcatcagagaagaacccaggtacaatgacagcccagcttaatacatgatggctgatgaatgaaaatgtctagggaaatgagtgtgttatgtacaatgtaatttcatatctaagtcactttaaaataattttttgatatataataaccctttcaatcacagaacacatatgtggcaccaatgtgaatactactttaagtattaaggtgataatatatccaatatacctagaaggaaaataaatacctgaaattcattttcatatctagcttaatgttaaaagcttctttttgtttttttatttcgtagcaaatctctttagctctgatgctttagtttctgtacaatgagaggattggactagattattaggtgaagagattaagtaagtgtgtgtaccctggtgtcaaattatcttattcttttttctttgtttttgttggactgggttaattcgaagaccttgtcttcaagctctgaatttctttcttctagttgttcaattctattgctgagactttccagagcatttcacctttctaaaattgtgtccaaagtttcctgaaatttttattgttttttctttaagctatctatttccttgaatatttctgccttcacttcttgtatcattttttgcatttccttgcattgggcttcacctttctctggtccctccccgattagcttaataactaacctcctgaattctttttcaggtagatgaagaatttcttcttggtttggatccattgctggtgaactagtgtgattttttgggggtgttgaagagccttgttttgtcatattaccagagttggttttctggttccttctcatttgggtaggtgctgtcagaggggaggtctagggctgaaggctgttcttcagattttttttttgtcccatggagtgttcccttgatatcatactttccccttttcctatgtatgtggcttccagtgagccaaactgcagtgattgttgtctctcttctgggtctagccacccagcaaatctacccggctctgggctggtattgggggttgtctgcacagattcctgtgatgtgaaccatctatgggtctctcagccatggataccagtgctgttctggtggaggtggcgaagggtgcaatggactccatgagggcctttagctttggtggtttaatgctctatttttgtgctggttggcctcctgccaggaggtggcgctttccagaaagcatcagctgtaatagtatagagagggtctggtggtgggtggggccctagaactcccaggattatatgccctttgtgttctgctaaccagggtgggtagggaagggcagggctaggcatgtctgagctcagactctccttgggcaggtcttgctgtggctgctgtgggggatgtgggtgagattcccaggtcactggagttgtgtacctaggaggattatggctgcctctgctgagtcatgcaggttgtcagggaagtgggggaaaaccggcagtcacaggtctcatccagatcccatgcaaacggaagggctggtctcactctaatcatgcctcctctaaccgccccaagtctgtttccaggcaaagggcaagactggcttgaaaacttgcctgaggctttctgcctcccagctgtgaaagaaaagggctttagtttttcccctgcatgtgaaatctgcatgctggattcacggcctccccccagttcaggccaggagacttcttgccctgttcaaatagttacaaagttcagctagagaattccttctccctgtggagttttataccctgctcctctggccaccctccagatggatccctgtggtgcctggcaagaatgggctgcttggggacccattgagctcccagagcctttctgcagcttcctctacccctgtattttgctccgtttggctctctaacttgactcacctccagataaagtcggaaacttctccacaaacagacgctcagcttctccggtcagagtgtgtgtttgggagaggagggtctccctttcccgtgagtcttttctttttgactgggaaataagtatctcccaatcttcagtaaataggatctttgctctccttttcccactcctcttcttggcccattacaaagatatttaccaaacatgcttagcctttatattcttctgttaatattaattcttttatttaatatgattgagcttccactatgttcaaggtcctgggattttttaggcaactgtaatgcagtccttatctttgtggagctcatggttaaatgaggaagacagacaaaaataattatgatccaagatgctatgtgctaaaatatactggcctaaacaaagtattattgggagcatagaaataagagtctttgtctggtggtcttggaaataaatatctcaagagagaagttgacatttaaaatggttcttgaagagtgaatgagaatttcttctcagattaaggggtaatcaaatattttagttcatggtaacagaaataatgaaatgtgaagcatattctagtagtaaagaacagaagtgtgaaagaaatggccaaaaagttcagtgtggcttcaatagatggcctatgagattgtgaaagcattttgtgtcaagccagatatatatattttaaaacaccttataagcaatagaacactaatagagacttttaaactggggagtgaaatgcttttctgaaacataattttgggagcagcatggaggagggatggggaggagagagatcagtattgagaaggccagtcaagaggatgcttccacagataagggaagacatgaaaaaggtgtggattggcaatgggaatggagaaaaagaattgaatttaagagatattcatgagctggagtcaactggacttggtgaccaattggatgatgaaaatcagagagaggaagaaatgaggaagactctgaggttcctagggtcagactagtgactccctgaaaagacagggtttggatttggtgaatgaatacagtcacgtgccacttgacgatgggaatacattctgagaaatgtgtccttagtgattttgttgtgtgaacatcatcgagcgtactgacgcaatgatgtctactagatggcagagcctactgcactacctaggctatgtggagtagcctattgcttctaggctacaaacctgtacagcatgttactgtactgaatactgcaggccatggtagcacaatggtaaatatttgtgtaactaaacacataaaagggacattaaaaatttctgtattataatcttatgggaccgccaccatatatacagtccatcgttgaccaacatgtcatttatgcagcgcatgactgtactgagctcagtttggaaaggctatacatgatgtgttagggtaaaaccagatagtgatgttgaaaggaatttggaaacaaggaactagaagtttgggctggagagaaaatgtgggctcctgggggtagacatgagagctggagccataggtgcaaatgagttcaggcagtgaacaccctgtccatgtgcccaaggagttttgcacagtagctgagcaatggcaagcaatgtgggtattcagaggtgtggataaaatcctctctccctcccactctgtggaagagagttgggttcatttaatctcatatgatttccctagtacaatagtttcaaatcaaaggcaatgaagtaactaacaaaataacttgtttgtaaattaattgctttgtgaatattgatacaaagttttataataccactgggattttttcatttttcatgaagaaatcagttttaactaggagaaaatcaatctttcatttttcttattatacacacttagagaaccaaagggttgttttgtaccccctatggagttccttggagagtaaaacaatgcacacattgtgtgtgtgttcatgagcactcttttggctttttctcctcacttttcttcttcccatttttttttttttgctttcttttttttttctccaaatgttaggcatttaggttagattgggtttatcttgtctatcctccctcccttccttgcctcaattacttctttagattatgggtgcctttgaatagcaatgtaagtttagaaatgatgcatatataaaaatctactaaccagggatctaaaggttttagctggtagactcataagacatgacattgcttttatgaaaggtgagaaaagtggtaggaagtacttttttttttaatgccagaatttcttagtaaaacatcaaatataactaaaacctaatataaacattgcaatttttagacttttgcctcttgtgtcacattcatgtgctgtgctaagctaacacttatcattgtttgattacagaaaatgtgtttaataagcactatcaatgattacaaactcaggacatcttatctttccatcactctgagacctttgtggaggtttgtggttagaagtctgagttaaagaaaataaaattacatttctgatatcttgcacgctctgcactgagtgggttctttaaatgtttcctccagaggattttcaaccaggaacaatacaactgcttgcaaagagtcccagcaggatgggtctgggcatgagcatcttatactggtgaaatgaagtagtccagatattaaaagcatcaacttgcaaatgaactcatctgcactatagtgcaattctcaggtgaatgaccttttcttcagaaattttcttaatagtcccccaaaagaagaagaaaatgttcttgtgctttataaattttgaaaacctaaagagatcacttaatataaagatttttattttactcttgaaaacattagtctattgatatcaacagtaatattataaaaattattattattattattttttgagacggagtcttgctctgttgccaggctggagtgcagtggtgcaatctcggctcactgcaacctctgactccctggttcaagcgattctcctgcctcagcctcctgagtagctgggattacaggcacacaccaccacgcccagctaatttttatattattagtagagacggagtttcaccatgttggccaggatggtctcaatctcttgacctcgtgatcctcctgcctcggcctcccaaagtgctgggattacagggcgagtcactgcgcccggcctataaaaattattgttagcagcagttaacagtcttgagcctctactgggaagaatatgccctgttagacacagtattctatgtgatgaagaaaatatagtacctgttctccagactgattataatctagggtttccaataaaaagtaaacagatatggtagcaaaacaaaacctcatgtttaatattcagattttaagactcatcaccaggatccaagaccacatattcctttttgtgattttagtaacatattaagtgctaaaagatataagatgatgtttatatcacaaaccactaacatgctgtgtttataaaacatcttggtatattagaacaaccattggtccaggggttcttgtcctggtcatatattgggcaaatgtaatggctgcgctttgggacatccaagtgagcaaccaggtttgttgctcacttggatggaacaaagttgtcctgccctccacagacatataagagccaagagaattatcaactgtctaaataagtatttatgaacccagtggatatttgaaggtaaagaaagtttttctttaaagctcagacagataatttccattagaacatgacatctcagttggggtagtgtcttgtatgcatgattgtgtatcttcatacacttgtttccagaagaaaagcaataatatggcatagctaactctgggatcatgccccagctatgagctatgtaatcctgggcaagatagtcaccttttctggctctagtttaatttgataaatgcaaatggaaaatgcaaaatgaaaggtttaacttgtcatttctagaagcccttttggctcttatattataaatcctgtgcttcatctcctcagatttaaaatgtcaccgtctatatattcatttgttcgcccatccaaccatgctttcatccatccaataaatactgattgcagcttacaacacaccaggtattattgtagatacttgggatggatttgtgaataagaccaacaaggtccctggttttaaagcttagagtggagtagccagacaataaagaagaaaacaatcagataaaccagataatttcagacagtgataaatgctttatgtcagttaatgtactagataatgacctggatatattctttagattgggtggccagtggtcactgaagaagtgtcattactcttgaacgatgacaaagaagcagccatgtgaaaatcagagagaatgttctaggtggagaaatgagaaattaaaagccctgggaacctgctttgtgtgtttgaggaacagaaagaagggcagtgtgactgtggtgtagtgtgtgactggtataaaatggggagaggtaggagaggtcatgcaagtcatgggaaaccagggtaagaacttagattttactgtaagtggaatgagaagcacctggaggttttataagcagaacaatgactctattggattatgcatgtaagaaggtcattctggtttctctgtggagaatggattgtaaatgggcaggagtaaaagcagaagctcttgtagtcccagagagagatgacaatggtttggaccagttgaagctgagatggaggagaagtggatagattctgttggacataaaacagaggtgctggaaattaggcgttcttcctgctcacagatttttagcactggtcctgtaacactcagttgttagtgaccactgtctagcttcctgtggttgcctgcttctattatacttctgttgattgttgctagtgacactttgactgtggattgaaccaaaaatctttcatgcacccaggaagctgtgtgacctcgggcaaataatttaatctgtctgggccttcagttgtctgtatgtacacaaaagaggtcaccagatctgactgtgtatgatgctgagaagaggttgaatcatgttacaggaaacaaaaagtgtaaagctgagggtatttataggatgcctgaaacatgaagtgttgatgaaatttattagcaatggaaatggtatgttaggaagcatgaggagcatatcaaagatagtatgagagaggatgttttggagaagattttatattaaaggtggtatgggaagaaaaggcaaacatgagaaaaaggaagaaagaacaagaagagagagattggtaaggggaacactgacaatttttaactactggtatggcaacagaattgaccaaatagatttgacaccttaccaatcagagcagacactatctataaaagtggtgctatctatcataccagcattccaggctgagtattagacttggagataagaacatccaagaaggatggagaaaagatcctagatgcttttgcagttataagaaactaacgtattcagatcttccttaaattgtctatccattaaatgctttagtcatggttataaggggcagtctcctttaatactattttcaaatgttaccaaaggctaagaagaatttgtaatttgtcatttgagcattgtcttagtccattttctgttgctatcactgaataccggagactgggtaatttataaagaaaagaaatgtatttcttacagttctggaggctggggcctaagtctaggggtctaggggcctaggtctaggctgaggcctaggggcgaaatctggtgagggccttctttctggtggggacactcatcagaggcccaaggcagtacagaggattacatgatgaggaggttcttgagagacagccaatctggctgtttataacatactaactctcatgataattaacccactcctgtgataacctattaatctgttaacccattaacccatgaattggattaagctattcatgggggttctgccaatcatctcttaaaggccccacctcccaattctattacactggggattaattttcaatatgagtgtcagtcagagggggacaaacattcaagctatagcaagcatatctgttctatatctgccaaaatagttatgaaataattaattaaatgctatagttaaaaacattcgaactgcagacttagagctgtcaagcggttttccagatggaaagtttaaacactggatatgtggaaacctaagtcagccttctgatcactacatttcataataaataggcgatccaggtagtttttaagttaaagataaaaaaatgagtaattaagagcgtccaggccaggtgcggtggctcacgcttataatcccagcactttgggaggccaaggtgggcggatcgtgaggtaaagagatggagaccatcctggccaacacggtgaaaccctgtctctactaaaaatacaaaaattagctgagcatggtggcatgtgactgtagtcccagctacttgggaagctgaggcagcagaatcgcttgaacctaggaggcagaggttgcagtgagctgagattgcaccactgcactctagcctgctggtgacagaacaagactccatctcaaaaaaaaaaaaaagagtgtccaatagaaatgacactctgaaatcttcagctgatgtcagtggcacacactctcaacatgccattcaagaaaaattgaggcacggcattcctggtcctacctaaatacttttgtgggcaagaaagacagtctcctttattttaatttattctgactttctggaatagcccattatgatattgagacagaaagtggttaacaggaacattgttttccctttggaagacttacccaacagcaaagaattagctctctcagttgtttgcagtcttatctggatatattctgatgctgaatccagagaaagcaggtgttagaaataacattaagatgtttttgtttcacttcttcatttcacggatgaggaggctgaattccacaggggtaccctagccacagagccttgctagtggcagagccagaatttgcctctggtttccttgggatccactgcaatgcacttccaccacactgcaccgccaaccattcatgtcctcttgtgtttgccacagtgcgggcacaatgggggaaaaatctgctgagaaaatcatcttcggaagtagaagacaatgcgtctatgtctgtgtatacatggtgaccacagacgctttggctccaagatcattgtggtttacttgctgccattctaaagtctctgggaaattttttgtgaacatttctaaaggaactgagaacccgtccactgattttatcttctgcagcagacggtagagacatacgcatcaaagcaacagtggggcaacatattttactgtcagacaaataaagccccaagcaaaataccctacgttttaatctaatgtagactgcacctgttctcatgccaacagtttttttttctttgcctctggataatattgttccttccagtttttaaaacgaagcaagtattattttccttctgtatgcttttaaacatacttgttattataaaacaaaacatacatatagaaaagtgaaaaaaatgtataatttaatgaataatgctaaagcatactatcttaccctcataatcaccacaggtcaagaaatacaagactgtcagcacccctatttccttctgattccaactctttctccctctttagacaaaaccattaggctgaattttgtgatactaattcagattatattaactatttctattttttagtaattatggaagaaatcaaaacatgtatacttcacttagaaaagtttcaaattacatataccttcactatctttctagacaatgtgctctatattgacagatgtttcttttagcacattggaggtatatgttataattccactgtatcagggcttttattgttgatgttgaaacagtctaatagttgctccttggaaggtaatcagtctcttttctctggctgcttttaggattttcactaagatacatctaggtgtgcatacttttaaaaaatatgcttgtgaattgttgggattcttgaatctgtggagtgtgactgggttctaactaatttttccaacctatctgctggttcaccaattttctctttaactctgtctaatatatattaaacttatctattgagttttaaatctcagtgcatttttttggccgattcttgtaggttctttttcaaattagttgacttaaattttcctgtgtactacagatattattacaagtttttctcttatttgcttaaacataataagcttaattactttattttggggacctgataattcaggtatataaatcatgagtttgtttttgtagtttgttgtttctgttgttcccttgttttcttgtatgtctcattatttttgtgatgtgtttgccattgaatgtgaatattatttgtatgaaattttttgaggcctaggatgtaaaccttttcttcttgtaatagtttgcatttttactttcaaaagctgaagggtaataataatgcaaatctccttaaagaaaattcaaggattgaggttttctaaccattgaagtccagaagatttttctggaccatctaatctgaatgaggtctggtttatttctttacctgtgctccaagaatgtaactctttggggtcccaatttattggggagagggttttctgctagatcactcactctgcagattctgggagttgagacataaaaacaaaagtttgaatttgaaagaacagcaatgctttccgagtaaaagcagcttccaagctttgcctgtctctcggggttctggttctctcttcaaatttagcctggtaatttctcctcctttgtgtcattctttaatgcttttaataatatttttggacatttgttcaacatttttggttgttttggcgtgagaattagtttgaataatagggactgctataactgaagactagaacacttgtgcttattttcacaatcaaatcacccaaattgaagatatatagggaaaatataaattgaagcccagggtcattaagaaaataagtaattgtgtatcttaaataaaattaaggcaactagtgtaagtagaggtgtgacaaatagcccctcctgcataatgctaatcctgttacaaatttcagaaagcaaaatggcaatacatagtattataacttttaaacattttgaccaaatgtcataatatttacataaaagcaaaatgctgaaaataatcccaatatccaacgttagtattttagttttaacaaattatgatagattaacattttggccaataatatagtcattaaaaaggataattatgatgactaaaaatgaaatgtttatgacataaaataacaatagcagaacacaaaataacatgtttgctataaataataagtatgtttttgcaagataaagagcaaaaatatacaaatagtatttctatttcactgtagaactaggtaatttttttccttaaaatttttttacacttacatagttttctcaaaaacaaagaccaagatttcaaaacttaggaaaaaaccagcatactaataattttcccaaacaatttcagcatgaaaatttgtcatattaaaaaggaaaataaaacaaaaagaaagagaaggcaatgagcagtttgaatttatagtctaataactcagaatctgcaaccaccaggccaaggtgatttcagttttttccttctgtgattcccatgtagcttgcaaaaacaaccttggcttcctataagcataaatttatttcagaaaatgaaaaagtggggctgggcatggtggttcacgtctgtaatcctagcactttaagaggctgaggcaggaggattgcttgaggccaggagttcaagaccagcctgggcaacatagcaagacctgtctctacaaaatttctttttcaaagttagccagatatggtggtgtgtgcctgtattcccagcttcttgggaggctgaggcaggagggacccttgagtcaaggaagtggaggctacaacgagctaggatcatgccactgcactgtagcctggggaacagagtaaacccttttctctgaaaagaaaagaaaagaaaagaaagagagagaaaaagtaaacaaaaatctggggctttatctttattatcaggccttgattcagttctcagtggatgaggtttggagaaaatacatttctgtcatttgaaaatgattagtctgttcttttactctttagcaggaggacataatgtatgtgtgtatatatgtatgtatatgtatacaattatttgtatatatacacacacatagtctctatatattgtaatatacatatacatataatacatatattttaatatataatatgtaatatacatacatatataaaatatatatacaattattcatttttaaactacttcgtacttttacaaagtgagcaatttctatctttccttttatctgctttactgatgtacatcagtgattatttactcatcagaagtacacatggttcttgtcagagtagtttgatcaacaggtagacaattccttctccccaagatatacctactaataaatgaagtttttcctaaacttcaacttttcccatatctctctgtttagctaagtgctactaatcctttaattccaattttaaaactcacttcctcaaggcggcattttctgattctataatcaaaattataacccacctgactctaccaccttcatttaaatagtactccattcctatcacaaattatgttgcattactacatatttattcctttaccatctgcctccaatatgaaagctaccaaaggacagaggccataccagtttgattcatacacactatgtaaatatattatttaatatttagtatattctatattcacatatgacaagcaagtttctggttaggatttttttttctctaggacatagttttatcttatgttcttccttgaggggtggagggagaatgtgaagctgtttcattttggtgcaacagagatgactttatgcattgaataaattgcttttatgttaaaatataattattagggcaacattataaaatgtcacttttgctttgttttctttctttttatgcaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatggtaagacattgctttcatcttccaaacttaagagtatatatatgttttgacaacttttctcactaataaaatcaattagacaaataaatatcttttgtgttggagttcacttagatgcagttgatggtaatcatttataatgaagatatacaggtgatgatttactattaatcataattagtattattcagcaatatgcaatgtaatcccatagactgctaagtcagaaatagatcatattgccttttaaacacatatgctattaaaaatcaggaaaaacattaagacaaatacttaaacttatggcttaataatgggtattatctctattcacctaagatttaaggtttggttttgcactgtgtttgtggaatgaagtatgatgattgaaaatcatagttttataacattacttttactattacctcttttataaaaatataggcagaaaagccctttctattaaccacatttgtaaatacattatatgcataatcttttaagttttagttcctggatccttgccataatactgagatgatgttagtctaataacttgcccacttactggatttcatgactataataaagaaaagcttcatttgattaaatagctcttttaaatttggtaagagaacttgtggttcagcagaatttttcattaacatacctttttttccaatccagaatcacaactttgttgccagctgaagttctggttacccataggatgtgcagcctttgttgtagtctgcattttgggatgcatacttatttgttggcttacaaaaaaggtaagcgatttctatctttccttgtatctgctttacagatgcacatcagtgattatttcctcatcaaaagtacacatggctcttgtcagagtaatttgaccaacagggagacaattccttccccccaagacatacctactaattaaactaatcacttggaacagaaatttatgtatttgttttatagcccacacattccaaagaggacttgacttgatggcttacagagagttacattattattattattgttcaaactagatgaggaaattgaggtcaagagaagactaaaggtcaggaggaaggttaaaacatcaaaatagatgactctgatttttaaaaaattattatgcatgggctgcgaatttgaatccaaggttcctgagaggcagggcagagatgaaacaattagttataagttttgcttagctggtaagttaaaaacagtcagcaagaaagccttctaaggtgtcaattgtagctgagaaggaaattgacaacttttttacatggtaggttattagactccttgcttttaaagaaaaccactgaggagctatttagaaagataaacaacaatgacaacaacaaaaatctccctgtgctgggggatattctttttggtctcttgcattacaggttctcaatcaaagaactgacaccactctgcatattacgcgagtatgctagtactcaagtatatccacagtgtggtcattggccagtgtatatctgtgggagagtggaatttggaaagagacataaagaaggaagagaatgagatagcgcccatggtctaagtctgctgggaaagaaacaataaaggcaaaaacgaggaagaaagttcagtagaaagctctttttatgtaaagcccttttcatattgtttttctacttagcctaaagccaggaacctaagtcacattatcatgtttttgtcacataccacttcaacaaagaatagaaaacagtcaaaaaacaaagagatggagaagaaaagatgaccaagcatgtttctggctttttctttcagaagtattcatccagtgtgcacgaccctaacggtgaatacatgttcatgagagcagtgaacacagccaaaaaatctagactcacaggtatgactccatttgggggtttgggaagggaagaggtttcttcacagtaagcctggaatgttaatttttttttttttaattttaaaggaaaggaaaacatctccaaggcctaattctagaattttctgtgaaaatctggatttctcacttttaactagatttatattttctgcagtatattgaaaacaaacaagcaataggtttgtaagccactattgaaactaaacacacaaacagctcataaaccaccatagtatcaaggcaattttcccattgatgtttcaaaagttgggatgattctaagtgttttttgttgaagggttcattcagtcattcaatgagcgtttattgagcatcagttaagtgtgagttactgagtgaggcactctggggaatttggacagatatatgctaattttggactgagattaggaagagagatctgtgctggtactgctagagggaagaaggagaaattgatgaagatatctggttattttgaggtaaagagtgtgcaagtttagagaacttggatggctttagaagtctcagtaacatggaaatttgaccttttctgttaagagtcagaaaactgaaagttgccaagtttgaggagcacccagaaagtttgaagcttccattgtggaaaattcatgtcttatgcccttgaggttcgaatgatgtgcgatgtgtaatgagacagaagccactgcatttttccacccctcagtggctacagattatctaaaggggacacacatagcttgcgttgtcatggaattatagcatgggatgggagctaaaaaggatccttgagttcacatttcatgttttagatgacagaaattgatgctcaaagtgttcagtgactcttttggttccctagacagttaatacctagctttgacacttgcaaagagcttatgtttcattactttgctgtttaaaaaatatatgatctctcaatctctttgcttaatgtgttctggctgtttggatccccacaagcagaacctgacataaggacttgggtgcaagtagtttatttgggaggtgatcccaggaagaaggggtgagggggcagggagagtgagacagccaacaaggagaagcaaatgaagggcgcattattatcaaggtctcagctccaggccacagaggcctgacttcattggacctctgagaagtgtacagatgcctcccagaatcattctcttgaaggatggcaaccactggctccatcctcactgatttggggttgcctgcggagggcattagctttccctcatctctgagctgtgcctctacttgggatgagcctacttgggatgagtcttcagagaaagtctggaggcagaaaagcagtgaaatgcagtggggctgttgtgctagaacagtcagcccatgcagcgctttctgccccagcagcagctgcaatcagaggtggacagtttcaaagtgatgagtttagataatgtctgttataggagtcgagagctaaacttctctggaaatggggaactggtgctgggtgttgaagcataaagatgagtttgcatggtgtgtgtgtgagtgtgtgtgtgtgtgtgtgtgtgcacgtgtgtgtttgtgtgtatgaaaggcaatggagaggggaaagcttcttgtagggaactggcacatggagagcatttagataatttatgctgaatttttgttacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 93 - DNA, 6447 bp, Homo sapiens
  1st Promoter of ICOS
ttttctccccttgaggtagaaacattacacctccaattgaccaggacatctttttttgcattcaaattatcttggaatttcctctaggacctaagtatccttccaccatgaaaataggagaccaaaaaaagtaatgcttccagtaatttctagccaaataaatgaggataagtgtgtgagtgtggtggggtagttaagagtttggaatccagagtttcactgtctggatttgaacaggctccgttgctcatcagctctgtgactccgggcaaatgactgaatctctctaactctcagttttctcatctatgaaatgagaataagtaacagactctccctcgctgagttgtttgagaacgggatcagacaatgcacgtggagccccgtgtctggcacacactatgtcctcattgcatatttattattaggtttctgctttgtatttttctctgtgcaacagccctgagctctagaacttatgacagcttttctcaagtgaagttaaagttccccatactcagttccagagctaggcctcacctaggttggaagaagtcaattgttctccactgcctgcctgtgtgctgggaaaggactctagcacagtgccggtggggctggaagcctttcctcatgatgctacggggagtacagtgaaaagggaggagattggggtagcaaggtcccaggggtcctggcagcccaggctctacttctcaggctagctcagtccctcaaacagcttccttcacacccactgctgagacccaggagccctacagaaggtagctaggggaagcttcagcagctagggggatccctgcaggatcagcctcctccttaccttgcagaccccttggctgtggtctggcattcctagtggctggcctaaagccccaaacctggaatctgtttcagagcctggaccttttggactcacaccttggtttccctggccagctgatttcagcttctcatctaaatgtcatttctgcaggctaagggaagtccagcctggatctagcatcttggaagcgcgttcagacttctggatggagggatcagcaggccttggtattggtggttctacctgcttcggttaagagtgaggactctggagccagactctctaaatcatagcactgacacttactatatgacttgggccaggttcgttacctgtctgtgcctcagttttcctcatctgtaaaatgggagattagtggtcaccattgggatgattaagaagattaaatgagttaatgtatgtataaactatagttataatgtaaatatatatacaaacagtaaccatttacatgcatataaaacataatataaatgtaatattagctatattcatatataaaaataggtatattttatatataaaatatattacatttaattttttacattttgcattaagatatattatttcatataaaacatttaagtacatatacatataattatctatgtaattattattgttattgttgttattgtctactttacctccctgcagggatggggagaccacggcaggcttttaaacattcttggtctcactgagccgtaggtgaggaatccctggttcctacagactctgctgtaatatgaggagcagggtttaagttagtttaaaactgaccccatcatttgaaacattgcaatctacaatgaatgccacataaatatcatttctcagattcctatgatgctcttctttcagatcttttcacttcaatttctataataattttgtttgtttcttgtcctatttcaaaggctttcttatctctggagcacctagcataagatagaaatgtgtcaaaatatatgttttattcatcatgtgagtatttttaggtcctgttaacccccataactattgattcagagaagtagggtggttctgaaaaatacaggcataatctctttaacttgttttataggaaccagaataagggtaatgttttcctctgtcttcaaaatcatcaataatccatgcattgtttaactcatgtcataagcaataatgcctttcatatagccattggcatcaaagaagaaacacccccttgatttgatggtaagcgtgacactacataaactcccagaaaacccacttcctttccagcaaatagaaaacaaccgagagcctgaattcactgtcagctttgaacactgaacgcgaggactgttaactgtttctggcaaacatgaagtcaggcctctggtatttctttctcttctgcttgcgcattaaagttttaacaggtaagtggtgtattgaatatttcttattaagttataattcaagtaaacattaagaaaaagcaaaggtagaaaaattacgcacccaaaagacagtggttttggtttttgaaagtaggaatagtttcaggatatggccaagggcaccatgtcactcatgtcactgtggatggcattgagtttgcattgctgcctttgatactgtgtcttgagatgaaaaacatgtttcatcagaccattaaatttttaaattacctgcttggagttacctgtcagtggataaactagcagagtggcttactgttcttagagaaagatgaaaggcaaaatgacttgtgtcaacagaatgaaaattaaatagctctggcatttggactgggaattctttctgtggtagaaaataaaatgggaagtctttgaaaagaaggattttgattttaatcttacctggatgatctgttatctgaaatgtccagggcaccatagagtttttattgacactaagtatcagagttcaccctaaaaagccaaggaggaaaggataatgtaaaaatacttcctagcccctgtagaccttacaaaaaagatcattctggagtccctgattccttctcttgaatggcatatagcagactctatatggacaatttaaataatgctacatacaatgtaagttaatacacgtgtttctgctgctttttactgtatataatttgtactacttttgttttctctttcacactgagccctattcttgaggttgaaaaaaggaaagttaagtaatattaaataacttaaataatcaaataaactaaaagtgaaggcagaacttttagtaggtatgatcctatctagggatacattttttcagtggcaaaaaaatagaccttactgttcttacaaaaaatgaaaaaaaaatgaaatcaaattgatcaaatgtttcatcttgtgctggctcaaagtgagttaagtgcagttaagaggattgaggaatgtagaatgagcacaaggacagttttgggctacttgctggtttatgccttttctagaatctcatgaagtcctttagcggcatgaatgacatgagcagctttggaatttatattcattcttcattcatccatttactcatgtagcattgagcacctgcctggtagcaggtactgtgccagatggtgtatgtacaaggatgagcaaaaccaggtcaacccctgttctttggaaggtaactgcatggtagagagagatatattaatcaaataatcccattgattaatgataattacaggcaaaactcaattatatgagggaatgtaacaaggagcttgactagactgggtgggtgtggaggtgtagctgaggagcagggttcattgaagtctttcctgtgcaagtggcacttgagcggagatttcaaggacaaggtagcaatcaatggggagaacggtatgaaggtagggaagaacgttccataccatggaaggaacaagtgcaaagagcctgtggcaggaaggaatgaggtaaggttagggaactagaagaaagcagacagatgtgcctgagcacaaagagggaagaggctgagcttggtccaagatgaccaactggtccaagttggtccaaggtgaggctggaaaggaaagtagaggccagaccattcagaccatatagtctatgttccagattttggatattcttccaagaacgttggtaccattcgtggaagggtttgtttgtattgataaaaatcattcaactaggccaaaccaatttgggcagttctggttgtggtattatgctcaggagaattaaagtagcatcggtgtcaattctgtggaaggtgagatccagccttaggtaggattgttttaagtttccagattaagctgacgaataatttgtattctggaacaatattcatcgtagattctaaatgaatacaaccaatgttcactctcattataaagaaagccatgagatgtggcatgctgtttggcatgtggcaaacctgaggcacgagtggctaaatggtaacaataaatctgctagcaatgatcctatttaaaatatctccacaatgcatgtatccagaaactgccatgtaaaagctctaaagaaaaagagccaaactcaagtaaactaagtacttgcttgtcctctgttgtattttcaatcctcccaatttacataggctttctcatgccatgaagatgtaggcattcttacctttagtcagtgtttgaagaatttccaaccaggaaaggttaagtgatttgttacacagtagttggtggcagaaccaaagttagaactctaatgtgactccaacatctacattctttctaaactgtgttgaagtagtggaggtgtaacataaatctaaaggaacgtaaatctcaatgattctgatcacctttgttatttggttgtgaattaagaaggatgggaatcttgctgatttctagtctttgatggatctcaatgtagaatttaacaaagtcttgtttttttttaatgaacttggagcaataggacacttttaattataaaaatatctacgaaaaatgtgaatgtctaactacattttgaagaccctctttgtagaccttataggcaacagggaccatatgagtgatgggacaaattctggttttagaaagactactttaaaagcagtgtggataatacaccagattgggaagggctgatggcagagggtgtctaataaacgtgcatgtattatgatgtgttctgtgaggaagctgggaggatagccctcaaggccactttgagccttcctttgtcactgaggcattccattagtgactcctgaattccacttgggaaaagagcccctcagtgtctccagcgtctgagagaagtctgtgaagatgactgaccttggagcccctcttagcctctccacgactgagtaaatgtcatctcctgacagcacccccttccagagtgttcttgttagatttaacaaaaatcccagttgtcaattttttcttttgatagatgaattcaggccattcccagtcagcataagcctctacttgattttatttctatgtttatttactacttatttttctttgttgtatcctctttttctcttttatttttgttggtgtgatgaaatttcttttgactctcctctttgcctccggttaatttggaaggtcgactacagttcttaatttactaagtaattgacatgttcaaagaatcttaattgaatgtctacttgtttatcattgtatgaaaataatgaaaatgcctttgtctgatgtgcctagtccccatcccctgcactgatatgagaacttaagaatgttcttcctttcccactctcacacttcccccagacagtgcaccctgctccatacgtgggttttgtggaaataatttaaaacttacagttgcagatcattgctaggtttcctcttacagtatttctcttctgtttcaagaatcctttcttaacacttacatcacatacgttcaatgacaacatcattctggacatctgctcctgtcttgtgatctctgttctaatctaatgatcagaagacttctcttattttcgttaaatacccccaactctctgaattccagtacaggtaagggtgtcttccttttaccttgatgagtgactgatatctttcctgggaataggagtcctggatggcagcctttcttcttagtggttgcagatattcctccactgtctgctggcttctagggttgtgggtgaagagtttgatggtagtctaactctcattcctttgtaaaaaaaaaaaaaactctagaatttcataatcttgaaagctatttacttcagtattggaattcaggaattcctccaggatatgtgtaactctctccctctgtttctctttctgtgtgtttctattaattttttttttgaggcggagtctcactctgtcgcccaggctggagtgcagtggcgcaatctcggcttactgcaacctccacctcccgggttgaagcgattctcctgcctcagcctcccaagtaggtgagactacaggcacccgccaccacgcctggctaatttttttgtatttttcgtagagacggggtttcaccgtgttagccaggatggtctcaatttcctgacctcgtgatccgcccacctcc

SEQ ID NO: 94 - DNA, 5089 bp, Homo sapiens
  2nd Promoter of ICOS
acaccaggtattattgtagatacttgggatggatttgtgaataagaccaacaaggtccctggttttaaagcttagagtggagtagccagacaataaagaagaaaacaatcagataaaccagataatttcagacagtgataaatgctttatgtcagttaatgtactagataatgacctggatatattctttagattgggtggccagtggtcactgaagaagtgtcattactcttgaacgatgacaaagaagcagccatgtgaaaatcagagagaatgttctaggtggagaaatgagaaattaaaagccctgggaacctgctttgtgtgtttgaggaacagaaagaagggcagtgtgactgtggtgtagtgtgtgactggtataaaatggggagaggtaggagaggtcatgcaagtcatgggaaaccagggtaagaacttagattttactgtaagtggaatgagaagcacctggaggttttataagcagaacaatgactctattggattatgcatgtaagaaggtcattctggtttctctgtggagaatggattgtaaatgggcaggagtaaaagcagaagctcttgtagtcccagagagagatgacaatggtttggaccagttgaagctgagatggaggagaagtggatagattctgttggacataaaacagaggtgctggaaattaggcgttcttcctgctcacagatttttagcactggtcctgtaacactcagttgttagtgaccactgtctagcttcctgtggttgcctgcttctattatacttctgttgattgttgctagtgacactttgactgtggattgaaccaaaaatctttcatgcacccaggaagctgtgtgacctcgggcaaataatttaatctgtctgggccttcagttgtctgtatgtacacaaaagaggtcaccagatctgactgtgtatgatgctgagaagaggttgaatcatgttacaggaaacaaaaagtgtaaagctgagggtatttataggatgcctgaaacatgaagtgttgatgaaatttattagcaatggaaatggtatgttaggaagcatgaggagcatatcaaagatagtatgagagaggatgttttggagaagattttatattaaaggtggtatgggaagaaaaggcaaacatgagaaaaaggaagaaagaacaagaagagagagattggtaaggggaacactgacaatttttaactactggtatggcaacagaattgaccaaatagatttgacaccttaccaatcagagcagacactatctataaaagtggtgctatctatcataccagcattccaggctgagtattagacttggagataagaacatccaagaaggatggagaaaagatcctagatgcttttgcagttataagaaactaacgtattcagatcttccttaaattgtctatccattaaatgctttagtcatggttataaggggcagtctcctttaatactattttcaaatgttaccaaaggctaagaagaatttgtaatttgtcatttgagcattgtcttagtccattttctgttgctatcactgaataccggagactgggtaatttataaagaaaagaaatgtatttcttacagttctggaggctggggcctaagtctaggggtctaggggcctaggtctaggctgaggcctaggggcgaaatctggtgagggccttctttctggtggggacactcatcagaggcccaaggcagtacagaggattacatgatgaggaggttcttgagagacagccaatctggctgtttataacatactaactctcatgataattaacccactcctgtgataacctattaatctgttaacccattaacccatgaattggattaagctattcatgggggttctgccaatcatctcttaaaggccccacctcccaattctattacactggggattaattttcaatatgagtgtcagtcagagggggacaaacattcaagctatagcaagcatatctgttctatatctgccaaaatagttatgaaataattaattaaatgctatagttaaaaacattcgaactgcagacttagagctgtcaagcggttttccagatggaaagtttaaacactggatatgtggaaacctaagtcagccttctgatcactacatttcataataaataggcgatccaggtagtttttaagttaaagataaaaaaatgagtaattaagagcgtccaggccaggtgcggtggctcacgcttataatcccagcactttgggaggccaaggtgggcggatcgtgaggtaaagagatggagaccatcctggccaacacggtgaaaccctgtctctactaaaaatacaaaaattagctgagcatggtggcatgtgactgtagtcccagctacttgggaagctgaggcagcagaatcgcttgaacctaggaggcagaggttgcagtgagctgagattgcaccactgcactctagcctgctggtgacagaacaagactccatctcaaaaaaaaaaaaaagagtgtccaatagaaatgacactctgaaatcttcagctgatgtcagtggcacacactctcaacatgccattcaagaaaaattgaggcacggcattcctggtcctacctaaatacttttgtgggcaagaaagacagtctcctttattttaatttattctgactttctggaatagcccattatgatattgagacagaaagtggttaacaggaacattgttttccctttggaagacttacccaacagcaaagaattagctctctcagttgtttgcagtcttatctggatatattctgatgctgaatccagagaaagcaggtgttagaaataacattaagatgtttttgtttcacttcttcatttcacggatgaggaggctgaattccacaggggtaccctagccacagagccttgctagtggcagagccagaatttgcctctggtttccttgggatccactgcaatgcacttccaccacactgcaccgccaaccattcatgtcctcttgtgtttgccacagtgcgggcacaatgggggaaaaatctgctgagaaaatcatcttcggaagtagaagacaatgcgtctatgtctgtgtatacatggtgaccacagacgctttggctccaagatcattgtggtttacttgctgccattctaaagtctctgggaaattttttgtgaacatttctaaaggaactgagaacccgtccactgattttatcttctgcagcagacggtagagacatacgcatcaaagcaacagtggggcaacatattttactgtcagacaaataaagccccaagcaaaataccctacgttttaatctaatgtagactgcacctgttctcatgccaacagtttttttttctttgcctctggataatattgttccttccagtttttaaaacgaagcaagtattattttccttctgtatgcttttaaacatacttgttattataaaacaaaacatacatatagaaaagtgaaaaaaatgtataatttaatgaataatgctaaagcatactatcttaccctcataatcaccacaggtcaagaaatacaagactgtcagcacccctatttccttctgattccaactctttctccctctttagacaaaaccattaggctgaattttgtgatactaattcagattatattaactatttctattttttagtaattatggaagaaatcaaaacatgtatacttcacttagaaaagtttcaaattacatataccttcactatctttctagacaatgtgctctatattgacagatgtttcttttagcacattggaggtatatgttataattccactgtatcagggcttttattgttgatgttgaaacagtctaatagttgctccttggaaggtaatcagtctcttttctctggctgcttttaggattttcactaagatacatctaggtgtgcatacttttaaaaaatatgcttgtgaattgttgggattcttgaatctgtggagtgtgactgggttctaactaatttttccaacctatctgctggttcaccaattttctctttaactctgtctaatatatattaaacttatctattgagttttaaatctcagtgcatttttttggccgattcttgtaggttctttttcaaattagttgacttaaattttcctgtgtactacagatattattacaagtttttctcttatttgcttaaacataataagcttaattactttattttggggacctgataattcaggtatataaatcatgagtttgtttttgtagtttgttgtttctgttgttcccttgttttcttgtatgtctcattatttttgtgatgtgtttgccattgaatgtgaatattatttgtatgaaattttttgaggcctaggatgtaaaccttttcttcttgtaatagtttgcatttttactttcaaaagctgaagggtaataataatgcaaatctccttaaagaaaattcaaggattgaggttttctaaccattgaagtccagaagatttttctggaccatctaatctgaatgaggtctggtttatttctttacctgtgctccaagaatgtaactctttggggtcccaatttattggggagagggttttctgctagatcactcactctgcagattctgggagttgagacataaaaacaaaagtttgaatttgaaagaacagcaatgctttccgagtaaaagcagcttccaagctttgcctgtctctcggggttctggttctctcttcaaatttagcctggtaatttctcctcctttgtgtcattctttaatgcttttaataatatttttggacatttgttcaacatttttggttgttttggcgtgagaattagtttgaataatagggactgctataactgaagactagaacacttgtgcttattttcacaatcaaatcacccaaattgaagatatatagggaaaatataaattgaagcccagggtcattaagaaaataagtaattgtgtatcttaaataaaattaaggcaactagtgtaagtagaggtgtgacaaatagcccctcctgcataatgcta

SEQ ID NO: 95 - DNA, 6765 bp, Homo sapiens
  1st Enhancer of ICOS
agggacttgccttgtttcagatgcgactttggacttggacttttgggttaatgctggaatgagctaagactttgggggactgttgggaagacatgatggtgttttgaaatgtaaggacatgagatttgggaggggccaggggcaggtttggctgtatggtttggctgtatccccacccaaatctcatcttgaattgtaatccccagaatccccatgtgtcatgggaaagacgtgatgggaggtaattgaatcatgagggtggtttcccccacgttgttctcatgatagtgagtgagttctcatgagatctgatggttttataagcatctggcatttcccttgctggcactcattctctctgctgctgccctatgaagaggtgccttctgccatgagtgtaagtttccttagacctcccaagccatgcggaactgtgtgtcaagtaaatgtcttatctttgtaaattactcagtctcaggtatttcttcatagcagtgtgagaacagatgaatacagaactgtagaatggtaactcaggagccaaagacagaactaagggagcctgaactctgcagaggctggaaggaatgggatccagagaggtgccttacttatgttttgaggaatatactatcattggaatgaaggccaacatgaataagtggcagtatatttgttaaaaatatcaatcataccatttggcagtcacatctcatgctgatttttttcacccctcatggaaatatataatcagttttctgggctttatggattaattaataactttaaatgagaaaatatttggctgtcaaaatggaatatacttttgttttatgattagagatgggcaagtgatgagagatgaatcaggatgatgaattatatatttattcaattaatttcaatgtgaaatacaaacatgttttgataattttctgctctcacattatgattcagagtgaaaaattgtcattggtgagcattcccaaggtcatatggttcctccaaaagtcaaggattcttcaaacacttgttcattcaataaatagttgtggagcattgcaaacatacttgcaaagaaggcatctttaggctgaggcgggcagatcacaaggtcaagagatcgagactatcctggccaacatggtgaaaccccgtctctactaaaaatacagaaattagctgggcatgatggcatgcacctgtagccccagctactcgggaggctgaggcaggagaatcgcttgaactcgggaggtggaggttgcagcgagctgagaggttgccaccgcagtccagcgtggtgacagagtgagactccgtctcaaacaaacagtaacaaaaaaacccgaagacatcttcagttcttgttctgatgtttctcacagtttagtagaagctgttggaaagcaaacaggccattacagtggtataattgttacaattgttacaggtagctagacaagcatgagctgggcaggagagggctcttcccccactcataggaatgctgggtgatggtttggcaattatcacattgcctctctaaaagtgataaattggcagctggtgccagggagaggtcatttcctgatggtccacacctgttgcactaaagtgttaattgaatgcgggtaccaggtagaagcaacttcctgggcctgcgcattaagagacaaaatggcctctggaggcacaccaccagaaaagggaagaaagcctcagatgagcacacgtacagtttcctaaacacactgcatgtgctcacctcctaagggtaaggagggcactgcacatgcgggcagcccaccctaagggaagaatcctgtgaaagaggccagcctataaagtcctaaaatcaaggttaaacaccacacttgaccttgggcctcttccaagcacatgctccttttttctgttctaaagctttttaaaataaacttctattcctgctctgaaacttgcctcggtctgtatttctgccttatgcttctcagtcaaattctttgttctgaagaggcaagaaatgaggttgctgcagacctgtacagattttctgctggtaactaagataccttccaccgataacataatgatttctaggatgggggacacagaggagcattgggaggttgcagaaaagccactaaatggacactagttatgggggtggttgggagtgaatgacattggtttgatgtctttgatgaatcgatgggtatggaagcaaaggcctgaagaatggtggaatatctgccaaagaaggtaggctagagtggtgaggaggggaagcacagacaaaatgatggctcctggcagtagaaggaagagttagtttggggaatttggagaacttcatgtcattcaacgtgatggaaacatttggtacagaaggaagaaagaacaaatgtggcaagagatgaggccgaactggggaaggagttgcccttcataaggaatcttgaaggggtgtgggccttacctaagagaggaagccagtggaggatcctgggtggggcggggacacagatgaattctatttacattttacaaagattactctggttgtagcatgaagacagaccaaaatgggacaagggtgggaatagaaatgacagaggcctgatctaagtcagtgaccttggcaagcgaggaggaaaaaatacttgagagacagttaggaagtagagtaattggggtttatcggtgaatcagcaggaaaagggagaaggctggttggtggtaccactcaacagtataggcaaggtaggagttgaagcaattgtgattaggaaggacctctcacttttgatgcttgtccctttcagaatggcaaaccaagcttaggtgaagcctagatatttgggggttactttctaaccctattgcttggactcaaccatgctggtgtctgagctcctctactcagacaaatgttgctttcagtaagttgcaagcaaagcaaaagaaagacattcacctacggcccttcagaaaagcaagcatgctgcatgatgaactctggtgcccaggaggcaagaaataaaaaacacttttaatgtaaccaactttccatgccccaccctcaccccaggcgtctgcatacacaaatcaaaaccatcttaagtcatggaatgaaaaaaaattaaaagcaaactaaaagcacttcctgtgaggtgaatggaaatttttgcccagttaattttccaggcacgtgaaagcagttctgaatattttaaaccacaagtacttgtattcttgaccaagatttttgagaaggcgaggcatgggaaggatcattgaaacaggactttgacataaaacattgtttacatagaagtgagctcttctccactatcggatcaatttaccacccagtgtctgacaaactgagaagcgagagggttgggaaaaagcaaagagatacatatcaaacaaaaccacacatatccagttgaactaaagctgaatttaaccataacttgtgcaacttttctccccttgaggtagaaacattacacctccaattgaccaggacatctttttttgcattcaaattatcttggaatttcctctaggacctaagtatccttccaccatgaaaataggagaccaaaaaaagtaatgcttccagtaatttctagccaaataaatgaggataagtgtgtgagtgtggtggggtagttaagagtttggaatccagagtttcactgtctggatttgaacaggctccgttgctcatcagctctgtgactccgggcaaatgactgaatctctctaactctcagttttctcatctatgaaatgagaataagtaacagactctccctcgctgagttgtttgagaacgggatcagacaatgcacgtggagccccgtgtctggcacacactatgtcctcattgcatatttattattaggtttctgctttgtatttttctctgtgcaacagccctgagctctagaacttatgacagcttttctcaagtgaagttaaagttccccatactcagttccagagctaggcctcacctaggttggaagaagtcaattgttctccactgcctgcctgtgtgctgggaaaggactctagcacagtgccggtggggctggaagcctttcctcatgatgctacggggagtacagtgaaaagggaggagattggggtagcaaggtcccaggggtcctggcagcccaggctctacttctcaggctagctcagtccctcaaacagcttccttcacacccactgctgagacccaggagccctacagaaggtagctaggggaagcttcagcagctagggggatccctgcaggatcagcctcctccttaccttgcagaccccttggctgtggtctggcattcctagtggctggcctaaagccccaaacctggaatctgtttcagagcctggaccttttggactcacaccttggtttccctggccagctgatttcagcttctcatctaaatgtcatttctgcaggctaagggaagtccagcctggatctagcatcttggaagcgcgttcagacttctggatggagggatcagcaggccttggtattggtggttctacctgcttcggttaagagtgaggactctggagccagactctctaaatcatagcactgacacttactatatgacttgggccaggttcgttacctgtctgtgcctcagttttcctcatctgtaaaatgggagattagtggtcaccattgggatgattaagaagattaaatgagttaatgtatgtataaactatagttataatgtaaatatatatacaaacagtaaccatttacatgcatataaaacataatataaatgtaatattagctatattcatatataaaaataggtatattttatatataaaatatattacatttaattttttacattttgcattaagatatattatttcatataaaacatttaagtacatatacatataattatctatgtaattattattgttattgttgttattgtctactttacctccctgcagggatggggagaccacggcaggcttttaaacattcttggtctcactgagccgtaggtgaggaatccctggttcctacagactctgctgtaatatgaggagcagggtttaagttagtttaaaactgaccccatcatttgaaacattgcaatctacaatgaatgccacataaatatcatttctcagattcctatgatgctcttctttcagatcttttcacttcaatttctataataattttgtttgtttcttgtcctatttcaaaggctttcttatctctggagcacctagcataagatagaaatgtgtcaaaatatatgttttattcatcatgtgagtatttttaggtcctgttaacccccataactattgattcagagaagtagggtggttctgaaaaatacaggcataatctctttaacttgttttataggaaccagaataagggtaatgttttcctctgtcttcaaaatcatcaataatccatgcattgtttaactcatgtcataagcaataatgcctttcatatagccattggcatcaaagaagaaacacccccttgatttgatggtaagcgtgacactacataaactcccagaaaacccacttcctttccagcaaatagaaaacaaccgagagcctgaattcactgtcagctttgaacactgaacgcgaggactgttaactgtttctggcaaacatgaagtcaggcctctggtatttctttctcttctgcttgcgcattaaagttttaacaggtaagtggtgtattgaatatttcttattaagttataattcaagtaaacattaagaaaaagcaaaggtagaaaaattacgcacccaaaagacagtggttttggtttttgaaagtaggaatagtttcaggatatggccaagggcaccatgtcactcatgtcactgtggatggcattgagtttgcattgctgcctttgatactgtgtcttgagatgaaaaacatgtttcatcagaccattaaatttttaaattacctgcttggagttacctgtcagtggataaactagcagagtggcttactgttcttagagaaagatgaaaggcaaaatgacttgtgtcaacagaatgaaaattaaatagctctggcatttggactgggaattctttctgtggtagaaaataaaatgggaagtctttgaaaagaaggattttgattttaatcttacctggatgatctgttatctgaaatgtccagggcaccatagagtttttattgacactaagtatcagagttcaccctaaaaagccaaggaggaaaggataatgtaaaaatacttcctagcccctgtagaccttacaaaaaagatcattctggagtccctgattccttctcttgaatggcatatagcagactctatatggacaatttaaataatgctacatacaatgtaagttaatacacgtgtttctgctgctttttactgtatataatttgtactacttttgttttctctttcacactgagccctattcttgaggttgaaaaaaggaaagttaagtaatattaaataacttaaataatcaaataaactaaaagtgaaggcagaacttttagtaggtatgatcctatctagggatacattttttcagtggcaaaaaaatagaccttactgttcttacaaaaaatgaaaaaaaaatgaaatcaaattgatcaaatgtttcatcttgtgctggctcaaagtgagttaagtgcagttaagaggattgaggaat

SEQ ID NO: 96 - DNA, 8544 bp, Homo sapiens
  2nd Enhancer of ICOS
ttgatgagtgactgatatctttcctgggaataggagtcctggatggcagcctttcttcttagtggttgcagatattcctccactgtctgctggcttctagggttgtgggtgaagagtttgatggtagtctaactctcattcctttgtaaaaaaaaaaaaaactctagaatttcataatcttgaaagctatttacttcagtattggaattcaggaattcctccaggatatgtgtaactctctccctctgtttctctttctgtgtgtttctattaattttttttttgaggcggagtctcactctgtcgcccaggctggagtgcagtggcgcaatctcggcttactgcaacctccacctcccgggttgaagcgattctcctgcctcagcctcccaagtaggtgagactacaggcacccgccaccacgcctggctaatttttttgtatttttcgtagagacggggtttcaccgtgttagccaggatggtctcaatttcctgacctcgtgatccgcccacctccgcctccgcctccgcctcccaaagtgctgggattacaggcgtgagccaccgcgccccgctgttctattaatttattattattttttttaagactgggtgaaagttttcaatctctagactcaagctttattcttcatttcagtcatttttttcctagtatttgtttaatcataccttatgctgtttttccccactctttctagaaatgtctcttattcttatgtaagatcttgagtcccttattttttcatcatttgtgaacaaaatggctttcacaacttgctgttgcttgttaaccacaactccttcagatgaaatggatatttcagttttaagttactagtagcatattcccatttcttggtagaaacaaaatgcaggcatgtaggggggactgaaattcttatatttactcactgtaagattcatagcattatttggcttaaaaaaattcatcccagtattcacagttgtaaacagcaaaatctacaacatatactgcttccctactctaagaatattgagttttatatgcaaaatgacttactgggctttgcaaatttttaaaaatgagttttaaaatcatttgtagcttgcaataactgaagaaaagatcacaatttctctgtaaatggcatctcagtactactgctgttctaataaactaggtctgtcaaatggcactttttggtcattcaaagtgaaaaaaacatggcatttgaaaccttataaaaattcacaattatattttggaaagtggaacttaagtatgtaggggatatgtcacacaaattgaaagtgttagtcaagaaatgattttttttttcaatagtttggcctgtaaggttgaccaaaacaggtaaagatttgcaagtttagagagtcagaaactggggatatgaacttccttctggttcatgtataacataatgatgcttgtatctactttgcttgaggaaaaaaaagaaacacgttgtccccaaatagggtgatagaccaggagtttccatccagttgaccacgagtgttgttaggatctgtttatttgagtcatgttgacacagacacagcactttcaataagcaattaatgatcatttaaaggtaacttttttgaatttgataaatagattttttttacagcctgtatttgtgttcttctaggactttgcaacaaagaatctgtacatgcaaaaacaacaataacaacaacaagctgtctactgcactcacagttaaagttctgtttactttgcactatctaggactaatgcaaaaatctcatagatgtgcctatttgcacttatttaattatgatgaaatttacttctatatgtgaatccatttctgtacatttctacaggcagataagtgatgggaaaatcattaagaatttagacttcatcagagaagaacccaggtacaatgacagcccagcttaatacatgatggctgatgaatgaaaatgtctagggaaatgagtgtgttatgtacaatgtaatttcatatctaagtcactttaaaataattttttgatatataataaccctttcaatcacagaacacatatgtggcaccaatgtgaatactactttaagtattaaggtgataatatatccaatatacctagaaggaaaataaatacctgaaattcattttcatatctagcttaatgttaaaagcttctttttgtttttttatttcgtagcaaatctctttagctctgatgctttagtttctgtacaatgagaggattggactagattattaggtgaagagattaagtaagtgtgtgtaccctggtgtcaaattatcttattcttttttctttgtttttgttggactgggttaattcgaagaccttgtcttcaagctctgaatttctttcttctagttgttcaattctattgctgagactttccagagcatttcacctttctaaaattgtgtccaaagtttcctgaaatttttattgttttttctttaagctatctatttccttgaatatttctgccttcacttcttgtatcattttttgcatttccttgcattgggcttcacctttctctggtccctccccgattagcttaataactaacctcctgaattctttttcaggtagatgaagaatttcttcttggtttggatccattgctggtgaactagtgtgattttttgggggtgttgaagagccttgttttgtcatattaccagagttggttttctggttccttctcatttgggtaggtgctgtcagaggggaggtctagggctgaaggctgttcttcagattttttttttgtcccatggagtgttcccttgatatcatactttccccttttcctatgtatgtggcttccagtgagccaaactgcagtgattgttgtctctcttctgggtctagccacccagcaaatctacccggctctgggctggtattgggggttgtctgcacagattcctgtgatgtgaaccatctatgggtctctcagccatggataccagtgctgttctggtggaggtggcgaagggtgcaatggactccatgagggcctttagctttggtggtttaatgctctatttttgtgctggttggcctcctgccaggaggtggcgctttccagaaagcatcagctgtaatagtatagagagggtctggtggtgggtggggccctagaactcccaggattatatgccctttgtgttctgctaaccagggtgggtagggaagggcagggctaggcatgtctgagctcagactctccttgggcaggtcttgctgtggctgctgtgggggatgtgggtgagattcccaggtcactggagttgtgtacctaggaggattatggctgcctctgctgagtcatgcaggttgtcagggaagtgggggaaaaccggcagtcacaggtctcatccagatcccatgcaaacggaagggctggtctcactctaatcatgcctcctctaaccgccccaagtctgtttccaggcaaagggcaagactggcttgaaaacttgcctgaggctttctgcctcccagctgtgaaagaaaagggctttagtttttcccctgcatgtgaaatctgcatgctggattcacggcctccccccagttcaggccaggagacttcttgccctgttcaaatagttacaaagttcagctagagaattccttctccctgtggagttttataccctgctcctctggccaccctccagatggatccctgtggtgcctggcaagaatgggctgcttggggacccattgagctcccagagcctttctgcagcttcctctacccctgtattttgctccgtttggctctctaacttgactcacctccagataaagtcggaaacttctccacaaacagacgctcagcttctccggtcagagtgtgtgtttgggagaggagggtctccctttcccgtgagtcttttctttttgactgggaaataagtatctcccaatcttcagtaaataggatctttgctctccttttcccactcctcttcttggcccattacaaagatatttaccaaacatgcttagcctttatattcttctgttaatattaattcttttatttaatatgattgagcttccactatgttcaaggtcctgggattttttaggcaactgtaatgcagtccttatctttgtggagctcatggttaaatgaggaagacagacaaaaataattatgatccaagatgctatgtgctaaaatatactggcctaaacaaagtattattgggagcatagaaataagagtctttgtctggtggtcttggaaataaatatctcaagagagaagttgacatttaaaatggttcttgaagagtgaatgagaatttcttctcagattaaggggtaatcaaatattttagttcatggtaacagaaataatgaaatgtgaagcatattctagtagtaaagaacagaagtgtgaaagaaatggccaaaaagttcagtgtggcttcaatagatggcctatgagattgtgaaagcattttgtgtcaagccagatatatatattttaaaacaccttataagcaatagaacactaatagagacttttaaactggggagtgaaatgcttttctgaaacataattttgggagcagcatggaggagggatggggaggagagagatcagtattgagaaggccagtcaagaggatgcttccacagataagggaagacatgaaaaaggtgtggattggcaatgggaatggagaaaaagaattgaatttaagagatattcatgagctggagtcaactggacttggtgaccaattggatgatgaaaatcagagagaggaagaaatgaggaagactctgaggttcctagggtcagactagtgactccctgaaaagacagggtttggatttggtgaatgaatacagtcacgtgccacttgacgatgggaatacattctgagaaatgtgtccttagtgattttgttgtgtgaacatcatcgagcgtactgacgcaatgatgtctactagatggcagagcctactgcactacctaggctatgtggagtagcctattgcttctaggctacaaacctgtacagcatgttactgtactgaatactgcaggccatggtagcacaatggtaaatatttgtgtaactaaacacataaaagggacattaaaaatttctgtattataatcttatgggaccgccaccatatatacagtccatcgttgaccaacatgtcatttatgcagcgcatgactgtactgagctcagtttggaaaggctatacatgatgtgttagggtaaaaccagatagtgatgttgaaaggaatttggaaacaaggaactagaagtttgggctggagagaaaatgtgggctcctgggggtagacatgagagctggagccataggtgcaaatgagttcaggcagtgaacaccctgtccatgtgcccaaggagttttgcacagtagctgagcaatggcaagcaatgtgggtattcagaggtgtggataaaatcctctctccctcccactctgtggaagagagttgggttcatttaatctcatatgatttccctagtacaatagtttcaaatcaaaggcaatgaagtaactaacaaaataacttgtttgtaaattaattgctttgtgaatattgatacaaagttttataataccactgggattttttcatttttcatgaagaaatcagttttaactaggagaaaatcaatctttcatttttcttattatacacacttagagaaccaaagggttgttttgtaccccctatggagttccttggagagtaaaacaatgcacacattgtgtgtgtgttcatgagcactcttttggctttttctcctcacttttcttcttcccatttttttttttttgctttcttttttttttctccaaatgttaggcatttaggttagattgggtttatcttgtctatcctccctcccttccttgcctcaattacttctttagattatgggtgcctttgaatagcaatgtaagtttagaaatgatgcatatataaaaatctactaaccagggatctaaaggttttagctggtagactcataagacatgacattgcttttatgaaaggtgagaaaagtggtaggaagtacttttttttttaatgccagaatttcttagtaaaacatcaaatataactaaaacctaatataaacattgcaatttttagacttttgcctcttgtgtcacattcatgtgctgtgctaagctaacacttatcattgtttgattacagaaaatgtgtttaataagcactatcaatgattacaaactcaggacatcttatctttccatcactctgagacctttgtggaggtttgtggttagaagtctgagttaaagaaaataaaattacatttctgatatcttgcacgctctgcactgagtgggttctttaaatgtttcctccagaggattttcaaccaggaacaatacaactgcttgcaaagagtcccagcaggatgggtctgggcatgagcatcttatactggtgaaatgaagtagtccagatattaaaagcatcaacttgcaaatgaactcatctgcactatagtgcaattctcaggtgaatgaccttttcttcagaaattttcttaatagtcccccaaaagaagaagaaaatgttcttgtgctttataaattttgaaaacctaaagagatcacttaatataaagatttttattttactcttgaaaacattagtctattgatatcaacagtaatattataaaaattattattattattattttttgagacggagtcttgctctgttgccaggctggagtgcagtggtgcaatctcggctcactgcaacctctgactccctggttcaagcgattctcctgcctcagcctcctgagtagctgggattacaggcacacaccaccacgcccagctaatttttatattattagtagagacggagtttcaccatgttggccaggatggtctcaatctcttgacctcgtgatcctcctgcctcggcctcccaaagtgctgggattacagggcgagtcactgcgcccggcctataaaaattattgttagcagcagttaacagtcttgagcctctactgggaagaatatgccctgttagacacagtattctatgtgatgaagaaaatatagtacctgttctccagactgattataatctagggtttccaataaaaagtaaacagatatggtagcaaaacaaaacctcatgtttaatattcagattttaagactcatcaccaggatccaagaccacatattcctttttgtgattttagtaacatattaagtgctaaaagatataagatgatgtttatatcacaaaccactaacatgctgtgtttataaaacatcttggtatattagaacaaccattggtccaggggttcttgtcctggtcatatattgggcaaatgtaatggctgcgctttgggacatccaagtgagcaaccaggtttgttgctcacttggatggaacaaagttgtcctgccctccacagacatataagagccaagagaattatcaactgtctaaataagtatttatgaacccagtggatatttgaaggtaaagaaagtttttctttaaagctcagacagataatttccattagaacatgacatctcagttggggtagtgtcttgtatgcatgattgtgtatcttcatacacttgtttccagaagaaaagcaataatatggcatagctaactctgggatcatgccccagctatgagctatgtaatcctgggcaagatagtcaccttttctggctctagtttaatttgataaatgcaaatggaaaatgcaaaatgaaaggtttaacttgtcatttctagaagcccttttggctcttatattataaatcctgtgcttcatctcctcagatttaaaatgtcaccgtctatatattcatttgttcgcccatccaaccatgctttcatccatccaataaatactgattgcagcttacaacacaccaggtattattgtagatacttgggatggatttgtgaataagaccaacaaggtccctggttttaaagcttagagtggagtagccagacaataaagaagaaaacaatcagataaaccagataatttcagacagtgataaatgctttatgtcagttaatgtactagataatgacctggatatattctttagattgggtggccagtggtcactgaagaagtgtcattactcttgaacgatgacaaagaagcagccatgtgaaaatcagagagaatgttctaggtggagaaatgagaaattaaaagccctgggaacctgctttgtgtgtttgaggaacagaaagaagggcagtgtgactgtggtgtagtgtgtgactggtataaaatggggagaggtaggagaggtcatgcaagtcatgggaaaccagggtaagaacttagattttactgtaagtggaatgagaagcacctggaggttttataagcagaacaatgactctattggattatgcatg

SEQ ID NO: 97 - DNA, 17976 bp, Homo sapiens
  Coding Sequence of the ICOSLG Gene
ttttttcctttcaaatgaagaggttttattggaagttgcatagagaacacagtcagtcacgagagcagaaggagcaggttccaggattctggggagataagggtccaagctgagaactcccctgagaagtctgtatgcagacagccccgggtgatcctggctgtccaagggctgagggcgggttgggaagggccctcatcaccccaggggccagctccccacatagcagctgagtagcacccagagaacccggatcttcactcaaggtggctggcagcagagccacagcccaggccaccaaagccaccagagcccctgtgtggcaaggatcatgatgcgagggtggtgagttggttgctgttctcagcaggatcctgggtgtaaatggccatgcctgtccagcacggcttatggggctgagcatgtgagaacttgtgtggcctgtgcctgtgcaaacgcgtgtgccctgggtatcacacccagagccctgctgtgtgaagaagcctcagtcatcacgtgtgagctcacagtgggctggtcatggggccccttccacatggtgcactgctgctgcaggaattgctgtgtctgcaaattctggacataccagaccctaaatagaatgctgggagcaggcaggttacagaagcctctgagtgcggcagctctatgggaactggggtgcttcacttacaagtatttgaggtattacaatgtatccaattttttttttttttttttttgagacggagtcttgctctgtcacccaggctggagggcagtggtgcaatctcggctcactgcgacctctgcctcccgggttcaagcaattctcctgcctcagcctcctgagtacctgggattacaggcgcctgccaccgtgcccaactaatttttttctttctttctttcttttttagtcagagtttcgctcttgttcccaggctggagtgcaatggcgccatcttggcccactgcaacctctgcctcctgggttcaagcaattctcctgcctcagcctcccgagtagctggaattacaggcatgcaccaccacacctggctaattttgtatttttagtagagatggggtttctccatgttggtcaggttggtcttgaactcctgacctcaggtgatctgcccacctcagcctcccaaagtactgggattacaggtgtgagccaccgtgcctggccaatttttgtatttttagtggagacggggttttaccatctcggccaggctggtcttgaacccctgatctcgtgatccacccacctaggcctcctaaagtgctgggattacaggcatgagccaccgcacccggcctgtttattttgtttgtttgtttaactccccctgcacctccgccaaaaaaaaaaaaataaaagaaaaagaaaaactaacctgtaactctgaagtgtctggtagccaggtgcggtggctcgcacctgtaatcccagcactttgggaggtcgaggtgggcagatcatttgaggtcaggagtttgaaaccagcctgaccaacatggtgaaaccctgtctctactaaaaatacaattacctgggcatggtggcgcacacctgtaatcccagctacttgggaggctgaggcagaattgcttgagttcgggaggcagatgttgcaatgagcagagattgcactccagcctaggtgacagagcgatactctggctcaaaaaaaataaaataataaagtctcttgcctttggagtcgggcatgaaatcttaatccgtgagttttctacctgggccatggtgggccactgaccaccttcggcctggatgaaggctggcccccagagggttgccaagctttgccagtgctccctggcctgcgtggggcctggctgagggcgagggcaacaggaatgcattgtgtctggggctgagcaggacttgcggtgcctgggccctttgagcctggtgactcctgagtgtgactcctgagtctgaccccatcacccgtgtgggctgacaccagcaccttccacgctgtgcttctgtgtttgccgccggtctccaggagtggccgcttctccatcaaataatactccagtcttcacgcccatggcttcccccagaccccagcccagcccgagaacaaacgctccattttccctcccttacagctgcggtggttgccaccacatggaaggcccagaggaagggaggtctggagtggcctggagctgtggcctccccaggctacggccagacccaccaggaggaagccccttgcaggctctaaggttaacgccgccaaaccaagtcctgatcctgagaggctggctcaggatgaggatgggcggtggtgtcatgcacaggcacctgaggtccctggctgctgtggcacggagaggcccccacggaaggactccgcaggtgctggagctcgctccctgcatggacagctgcagcctgggcagggataggggagcaaagctgcaggcccggctcatcatggaaattcagaccggtgagccatggaaggacatcgccaagtccatgtagggtgagctggggacagcatggggagtgggaggggggacagtggggagaggggagagcggggtgagctgggtacagcatggggagggggacagtggggaggggggagagcggggggagcctggggacagcatggggagtggtgggggtgggggaaggtggagggagggcagtgcatggaggacagtggaagagggaggcagtggtgacagtggagagggaagacagtggggaggtagaagggaggagggtaggacagtccagcccccattggcaggggcagctggggagagcaggccccgcctttgtgtgccccagggcctgggcctgcctggttaagagtctgcacactcctagagctggagcttctcaatgtcgctcttggaaggtgaccccacactccgctggggataatgcagggggcccaggggtcctccctgggaaaagtgtgctgtgccccgccatagggttcgtggcagaagcccctcccctgagctcaggcctcacctccggccactgaagacaaggagatgcagagaggaggcctctggagtcttgccccttacccctgcacccctgcagcacaggcagggtgtggtggccgtcttggaggcacccgggcctggacagctattccaaagccatagctgccctccccagggtgggtcgcttggtcttaggagcgtccaagctgcagagcccagtagacagaacctggatccagcgcctcactttacaggaggggaaactgaggcacaagcatgtgctacctggctcgggggccagcaggcagccttttcccttctgtcacctgccctagggatggaccgccccatctgccagccttgactggagcctccctggtggatgtttaccgcacacctactacgtgcagggtggtgcagctggcgagagtcccctctcctgttccacagaccggcaaggttcccctgagccctggggcaggcaggacctttggctggaggtgggtgtgcagggcagggtctctgaggggagacctcagactgtggacttgcgggtggacgcttctctctgtcggggcctcccgtgtccagaagatgttgaacagcatctgaggcttccacccgctgaagccgaggaacagcccccagctgtgacaacccaaaatgcctccagacctggccccatgtcctccagggggacggaacagcctggtgtagggcagggtcccctgagcaggagtggcacctgttcctgctcataccacagacagctgagctggctgtgcccaagactccctgcacccaccaaagccactggatacaggcacgatttgcatcttactctcttaagtcaggtttctggagatggctgtcccaacactggaatccagcctgtctacagcaagggagaaagaggaagctgatgttgggctgagaggggcaggcgttacagggtaggtctcacaaatgccgacgtgacaggcagggcttctgagggggcttcagggaccagcagggaggcgagactcaggcactgacccgcagagagcatggccttggacgcacagtggtgacagcagcctccaagtgtcccccgtgccctcaggcatgagggacagaagcttctggggcccctgcctctttcctgcccatcccctggtgaaggaaaatcgcctctgataggaaaagctggggccagactccctctccctgcattagtgtcgccgtcctgcctgtgaggtccccgggcccagggcacctcccgggacacccgagtggtgatgcacgaccctcagtcctggggcttaggacctctgggtgcccccgcaggtccgtcctggagtcacttcacagtcactgcaaatgggcaccacagcccactttccaacgccccaactttccacacccaagcagctccttgtccctgccaatcaatgcccggtgatgacaactgttcttttataaacaccacacatcttctaatgctttcatgttaaaagcgggagtggatcccacattcacctaaaggctcaggtagggactttttttgcagaaaaccaatttcttgtaacaagtactggaacctcattgtagccttgagtcctcactcctccttttgttctaagtctgggtctgagaagtgcaggcctcacacagctgtcagttccaagtgaccagggctgtaacaggtcctggctgaccctgggaatgtcaggggattctgggaagtaagaaggaggggcatttgcccatagccccggggcagacaatgtgtcccgagggccaggccaggctgtctactccatctccctggggcgagtgcacctcgggtcacctggcagcatcctttccagcccttctggagacagtcagcagctgattcattccgggaaccagcatggcaggtgccggggctggtcagggcccagggctgtacccctcagcactggaccaccccgtctcctgcccccttgggactgttgggctccgaggagcctggcgctggggtcggaggtcttcatcaggaccctggggaccctcagggttgagtggggtggggctgctgagggtggtgggggccgggggagccacctctcactttggggatcattgctgaggtgagaagggggactgtggccaccaggtgataccctctccatgcacctaactgctgctcaggactctggggaccgtgttgccaggcctgcgcctgctggacatgggcgtctccagccctgctgggctgtgtctttctcgctgcagagccaagagccccggcagcccctgtagccaaacacggccctggcacagcctttcttctggcaaactccacccgtgcgtcttccaaaggtggctcaacttttcaccggaacagccgagggacattgttcctcccagggaatgtggcagaggacactgaagcccagtggggacttccgggggctcctcggtgtggacggctaactacacttgtgggcacacacatgagtgggtcctgtggcttccgggcgggaggcaggttgggagcgttcagggcagaagagctcctgtgaccgtgtcccctgcaaacagcctcgcgtgaccccagcagcacagaggccgtcctggaagagcggacgcccagtcttctttttaaaccaaacacccttcggtctcaggatcccgcatcccacgggaagacccacagtgggtctggggtactgggaagagcctggtgctgaatcccgcacgctccgggtagagacagcccatcaccagtcccttcctgtgggtgactggcagtgacagcggggagcccactcacttggggacatttgcctttggtgtggatgacgcttttgaaagggcctcattccaggatcacagccaacgccagcaggttctccctgggatccagcagtggtccttctgggggctgccccaagtgctcccctgcagtctgggagtccatgctcaagctgccacctggcctctcacggtggcgtctcacggaagccctgtccacgctctgggcggtgagctccggtcaaacgtggccttggaagggagatgaaggagagagaggaacatgaagcacccctttcccttctgcaggcagacgtcggttttctcaggactcagcttggtggaaacacagggtttaaagcttcggaaacagcggcctgttcagggaacttcgactggctccgacgggaacaggccggccgtgtttttagcaagctgtgttcctgcatcatctggatgggccgacctggccttggaagtgcgtttctgcggtcggccatcagctcgcctgggtccacaggtgacaccacagcatggtggctgcgcacaccctgagcccactgtccccggggaaccccttctcctgggcggcaaacagggctcggaggggatcctggcccatggcggggagcccggctggcctgcctgcgaagcccagcgccccttgcagccagaggcacctgccaggtgggtgaccgtgtgtggacatttttcccaaattggacaggaatccacatctatgttgctcctggaactgaggggcaaacgagagctgcaggagtggctgccacagagagaagctggcggtgcccggacccactccggacaccccacaggggctgggcgccggtgcctggacccgccctggacaccccacgggggctgggcgccggtgcctggacccactccggacaccccatgggggctgggcgccggtgcctggacccgccctggacaccctggtcggggctgggcactggggagcgcgggggtctagcactcgtctctctgcttctgtgcatgttgggaaaatcccatcgcagtgtgacaaagtgcacaccaggatgccatcccatgccaaggggaggctgcaggaaatgccatgcgcaccatcgagggcttcgctgcgtctccaggaacaacagttgttcaaggcaagggacttttgccttttgaaagttttttgaaactctgaaagacagctggcagccaagcctcccctgggccccccagaacctgctgcttcccacggcaaactcaccagtgagctctgtctccggactcacagcccaggcacctggaggacaaaccaaaatggtcagggcagcagcgatggggggtgtccctaaagcccctggtgttcctgagctctcagcagccccctaaacaccctacttggaagtctccccaaggctcccagctccaggcggggaaaacactcacagatgaggggctccccaggccacgtggcttttgagaaagatcctcttaaaggggtacgtgcctgggaagcacttaaaatgctgtgacctggatctggggcccttctgcggcccagccagcagtggcatcatggccgtggaagatgtttctgggatgactgagattggccacaaatgggaaagccaggggcagcccacaggagccgcccctactccgtggccactgcgcctgcactccattgactgccacccttggggggttctgggaagagccccccccgtcatcaggaccatcactgcagccaacgttcagggcttcctgcgccactgcgtcctgctgctgtgtcttacatggctgaaacacagacctccgggctctgtcgcggagctggccagagtcacagacccacagggcaggagtgctcaaggcagcctcagcggcttccctggaaatgaccaccaccccggcctctacatgcagaagccaccctgcccacccgacctgcagggcagacctcgcagcgcccttctggcttggcagtgtcaggaatgtcagagatgctgggtttcaaaaccactttgtgggatagttcgggttgctaagcctcatgaatattagtgctaccacaacaaagttcctttgtttttttgggggggacagagtcttgctctgtcgcccaggctggagtgtagtggcgtgatctcggctcactgcaagccccgcctcccgggttcacgccattctcctgcctcagcctcatgagtagctgggactacaggcgcctgccacacgcccggctaattttttgtatttttagtagagacggggtttcaccgtgttagccaggatggtctcgatctcctgatctcgtgatccactcgcctcggcctcccaaagtgctgggattacaggcgtgagccaccgtgcccagcctaccacaataaagtttcaagctaaatcagtatcagtgagggaagttaaagcaggcaaacattcacaccaacaggacaaacactaacatccacaatatggggccgtctctacctgcatagctgtgttggaggcatcggtccctgcacacccagcctatggccaccgccacgaccacaagcaggcacaggacagccaggatgctccacgtggccgcgtttttctcgccggtactgactggattctctgtgatcttgtctctctctccgatgtcatttcctacaagaaagaggaaaataacccgacttaaaggatcttagaggaaaagggtcttttttttcatccttgagtagaaagtgttgcaaggaagtatttattccagagaacttccctgacatgattttgaggttttaaaaacaccaaactgatgagatgagggttttctcttacagaggggcttcatttcctgcagggatcttgttcctcctcgtcctacctgggaggggcgataaccccaaccacagccaggggaccatagggctgggtatggtgggaagcacaggttcttactggattttttttttctttttttttgaggcagagtcttgctctgttgcccacgctggagtgcagtggcgtgatcttggctcactgcaagctctgcctcctgggttcacgccattctcctgcctcagcctcccgagtagctgggactacaggtgcccaccaccatgcctagctaattttttgtatttttttagtagagacggagtttcaccatgttatccaggatggtctcgatctcctgaccttgtgatccacccacctcggcctcccaaaatgctgggattacaggcatgagtcaccgcgtccggcccttactggatttttaaaaatcaaagtgaggtcaggcacggtggctcacgcctgtaatcccagcactttgagaggccaaggcgggtggatcacctggggttgggaatttgagacacacctggccaacatgcagaaaccttgtctctactaaaaatacaaaattagccaggtgtggtggtgcatgcctgtaatcccagctactcgggaggctgaggcagaattgcttgaacccgggaggcagaggttgcggtgagccgagatcgtgccattgtactccagcctgggcaacaagagtgaaattccgtctcaaaaaaaaaaaaaaaaaaaaaaggtgaaagccacataacataaaattaaccatttcattttatttattgagcttttgagacagggtcttgctgtgttgcccaggctgaagtgcagcggtgtgatcataggtcaccgcagcctcgacctcctgggctcaatcagttctcccacctcggcctcccaagtagccgggactgcaggcgtgcaccaccaggcctggctaattttttttttggtagagatgagatctcactatattgctctggttggtcttagggctcaagtgatcctcttgcctcagcctcctaagtagctgcaactataggtgtgcaccaccttgcccagccaaaatgagccactttatgctttatttatttatttacttttttgagacacagtcttcctctgtcgcccactctggagtgtagtggtgcggtctcggctcactgcagcctccgcctcccaggttccagcaattctcctgcctcagcctcccgggtagctgggattacaggcacatgctaccacacctggctaatttttgtatgtttagtagagaaggggtttcgccatgttgtctaggctggtctcaaattcctgacctcagatgatccacccacctcagcctcccgaagtgctaggatcaggtgtgagccacccctcccggcccaaaatgaaccattttaaagtgaacaattcagggtgccagtgccatcataaccaccacctaattccaggacctgtaacccccaaaagggaaccttgtgtccatgagcagtcactccccactcttccctgccgtctgctgtctttctgggcagttcatcggggagaatggtcgtgtccatttcagatggactgtgagcccgtgtcagcagcaagaaggagcagatccaaatgagggggtctcagaacagctggggcctctaatttttctcttaaattttgttctcatttagtgcttcatggcactcccttcaaatttcacttttaaaactctagcttggacgtggtggctcacacctgtaatctcagcactttgggaggcttaggcaggagcatcgcttgtgtccaggagcttgaatctagcctgggcaacacagtgaggccccatcgctacaaataatcaaaattagccaggcgaggtgcatgtgcctgtagtcccagatactcaggaggctgaggcaggagaattgctgtcctcctgcaccagaagcctccagttgctttgtgtctcagtggctcaccctattctggacactttgcataaacagagtcccacaggcttgtcctcaggtgtctggctctgtcactcgcataatggccttgaggttctccacgccgcagcgtgcgtcaggacagcggcctccttcctttttcaggctaattctcccctgcacgcatggatcacgtttggtgcatccgtccacccacgaggaacactcgggtggttcctaccttctggctgccatgaacattcacggacaggcatttgtttgagtccctgttctgaatcctctggcctatatcgctaggagagaactgctgggtcctgcagtgcttccacgctgagcttttcgaggaactgccacaacgttccccatggcagctgcgcccttctgcttttccgccacgatgcacaaagctaacaatgcctctggtctctgtgtgcagtgcccttcagagagccgtcctcaccggcaaacaagcagcggcatccccctgggagcttgttctgaatgcccggcgcgtctccaaacacacttggagaaaccacctggacggtgctcaaccttgaacctctgaagcttttagacactgtcccgatgccaggtgccagcccagagcttcaggtgcaatgggtctgggcatgggggctttcataggctgcccagatgaccccactgtgtggccggggttgagacgacagccctgggagaagcttctgctgccacctgggctgctctgcggggagtatgctggctggaaggcagttatcagaggctgctttgggagcagcccctcatcccgctgcatgcagctcagacactctgaatgttgagtcagaagggctgagccctgatttcaagaaggagaaggtccggctctgccggggatcctggcggccagggtggacttcgagggtatgacctgtgcaggcttctggggttgagctcagaaaggccggcaggaggtgcaatgcttgtggtcactgtctggaattcttaatgctcccgaaacaaggagccctgcattcttgctttgcccagggccacacggtgagtcctgctggcagcccctttcctgcagccagcagggccccaggacccctcctcgatcatctcctgcctccatcttctgcctctcatcctgacacaggagatggggacacaaatggggagggcctgtgtcctctacaaaggagtccccgtagaggaaccccttccacagggcaccccttccacagggaggggctgggccagcagccgtgcgcagtgggattcccgtgtctgggggcttcagtcttctcaggggacacacgcccaagaggcagggagcttgggtgggggctgcacagctgtgggcttctgttctgggctgctgctgcctagtgctgcggcttctgaagtgttacccagcctcagagttcagccctcatctgtaaagtaggtttaagaaaaccgactccaggtgaagaaaatggagcaatatgcactgggcacggcacccattcctgttcccagagaccgcggtggttctcactgtgcggcatgtgcctctcacctcccctcccttccaaccacctttcgggtgctgagccgcgtcgaagggactttttgtctcctacctcagaggctctcccaagccagccctggccccactgtcgggcacagctcagcacgcaggcgccgggaccttacctgtctggctgccgacagtcaggttctgctgcagaagcacgttctctatgcagcagccaatgttcacgctgggggtccgtgcgatcctcagcacgctgaccacgtcatacaagccccgcatgttcaagaagacggtgtcattctgcagagcctggtccagcaggctgttgtccgtcttattgatccagtacacgttgggcctggggtagccgtttatggatgtacacgtgaaggtgagctcatcctgggaggggctgtggggggcgctgacgacgggcacgctgaagtttgctgcaggggagggaaacagattgtgagagatgccagaccctgctggtcaagaaacagagggtacacggtgccaaggctgggtcagaggggaggcggcccattgtgccccgacatgggtgacaggccaggaccagggctgtggtccgagcagcaggctccgccctgtcctgcccaagagtcatcccccaagccagtcccagtagccagggaccgctgagcctgtcgggcagtgactggcacccacagaccccccactccacagccgtcggctgtgccgggaccccctcatttggatctggtcattctcactgctgacacaggggctcacagtccatctgaaatggacacagctgttctccccaatgaactgcccagagctccttggttgcctcttatttttctcttaaattttgttctcatttagtgctttatagagttcccttcaaatttcacttttaaaactctagtttggatgtggtggctcacgcctgtaatcacagcactttgggagggtgaggcaggaggatcgcttgtgtccaggagtttgagaccagcctgggcaacatagtgagaccccatttctacaaataatcaaaattagccaggcgaggtggcatgtgcctgtagtcccagatactcaggaggctgaagcaggagaattgcttgagctcaggaggtcaaggctgcagcgtgatcacgctactgcactccagcctgggcaacagtgagaccctgtctcaaaaaacaaactaattggccaggcgcggtggctcacacctgtaatcccagcactttgggaggctgaggcgggcggatcacgaggccaggaatttgagaccagcctggccaacatggtgaaaccctgtctctactaaaaatacaaaaattagctgggtgtggtggcacgcgcctgtagtcccagctactcgggaggctgtggagaattgcttgaacccaggaggcgggggttgcggtgagccaagattgtgccactgcactgcagcctgggtgacagagcgagactccgtctcaaaaaacaaaaacaaaaacaaaagctaactaactcaagaggcaaagacagcaagggtaggagctcttccgggaaaccaagcagccgcaggtcatgcactaaggatttttcagctgtttagtttccctcgaagttagacagaagcctgataacacagatgagaattttcttcactggaagaaacagtgaatgagccagggagggggtttcatgaacacttgtccacgatgtgaggctgggatggacctagctctccccgcctcgatggtcctacctgccacatgcagtgtaacctcaacgctcaaaacctcctggaatcccagggattggctcaacaccaggcagtgaaacttctgctcgtcctggggggtgacgttgaacaagcgcagggagaagtcgccccgcagcatgccggccggtgacatcagggctcggttccggtagcggctgtccacgttttccaaggagctgttctgtgggatgtggtaggtcaccacggttttcgactcactggtttgccaatatacgtaaacatcatttaaatcaaaacggcttccttcagggcaagcgcagctgagctccacgtcgctgcctaccatcgctctgacttccttctcctgagtatctgcaatggcccaaaaggtgcaaaatctgttttcggaggctgatgcccaggccatgaagctactctatggggcagactttgggtttcaagcctcaaacaccaacggtggctcagaatttattaacaaggcacatgtaggaatgcagtcaaacttgaaaaacgcagacatttcatggtgaggtccatgtcagtctttggcttcgatgacacactcctgttatgtaaggggctgccatggggaggagcggctggatggggcctggccgctcagtgttatttttgttactcagcactacttttactacttctcgggagtctataattaatgcacaataaaaagttctttaagggaaaggcatttaagggaaaagaatttctcagcaattacattatattgctgctcacttgcagtaggaaagctgtcacaaatgtggcagacacagggtagctttactgtttgtgcagctacgtaaatgcctgtgggaaaatctttttttttgagatggagtcttgctccgtcacccaggctggggtgcaatggcgtgatctcagctcactgcaacccccgactctggggttcacgccattctcctgcctcaccctcccaagtagctgggattacaggtgcccgccaccatgcccagctaattttttgtatttttagtagagatcgggcttcactatgttggccagcctggtctcgaactcctgacctcaggtgatccacccgccttggcctcccaaagtcctgggattacaggagtgagccactgcacctggcacctgcaggaaaatctgtgtgtgtcccctgcccccaaagccctctgggctggaaggcttggcaaggtttcaggtttgtgctgcggtgcttcgtccttattcctggctcttccagaggctggtggctcttagggctcagcagggctgctgcctgggacagggagaccaggggacccaggaagccctggctcagaggaactgcattctgcccgcaacaaagacggagtcaaacaagaactccggagtttgcagaagtgtttccctttaaggaaacgcttctatcctgtgcagcaacctaggtttagggtccaactgtctccaaaggaccacttgagaagcaagaaggagcctggtgaggctgctcccagtgccctgcggccagcagtccacacagccggagagcccatctctgagctgggcgccccatggcaaagcaccccctgaacttaccagctcgaaggctgctgaagagcaggaagagcagtccaggactggaaaaaacaaccagaaaggcaggtgaggcggggccaccagggagttacctgtatcttccaaacaggaacaggctggttcccatgagcaggaggtagttaagcccatcacagaaatgtgaaggcagagccaggagcctgcctgcctctgttctccatgggaattcggggtccggggccaggaccaccaccctcctgcccagcacagcaagtccgaggggctggcagcctctcaccactctctagctctcgcggtaacaaatccccagaaacacagtgatgctggcgtgaggatgaaggggagcgagggacgccagtgaggctggtctagccttcctggggacagatgccaagaagttgtaggaaatcagaaaaaaaaaaaaaaaaaaaagctttcagggcacatatagtaggagtgtcacttaaaatgctggggagacggagaacatcaggcgtgcccgtgacagggtcaggtgagtgacgggacagccctgtgcggaacgcggatcattttgaaaccaaacctgagctcctcctgtttcagatcctgctgcagctggtgcccctgcctcgggcagcaaattcccctcgtgactccaatgcccctgccatcttgggtctgggagcctttgcaccctgcacgccacaggctcgccacctcctcccgccagcccccaggatgccttccccacgtgggggcccttagtggccgggaccactttggtagcagtgcttaccccagccccccaaaccatcagtttctggggccagctccccatgaagcaagagccccaggagcagggacatctccttctctgatgtccctgcacctccaaggtctgggagacgctcatccctcttctctgtggcctctgcctgggaaagcttgggggctttgtaagtcaaaggttggtcttgtgggaacctcccagtgggctgtccctgagccctggagccacagaaacccctgccccacccacgatggctgtcatctgagtctgcatggaggtgtgtctgtgccaagtgagcacacatgcaccaaggcggcccctggccaccaggggctcttgaagtctgcaggcggcccttcctctctctcccactccccctgttggggccaccattctggctggcaagatggctgtgatggcctccagcaggccccctgcctccacccttagccccttcaagcatttccccagagccaccatctaaacgacagctgtgagaactcctctgtgcccccatttgtctcccacagtgcccatattcatcaccagcccacaaggcccctcctgtctatggaggcctcctcaggacatctgggggcttcctgggccagggtggggggtgcctgctccaggctgtttctggcttgtcccctccctgggtgctgcctaagcagcggcctctgtgtcctttccttggaccctcagcacccctgcatctaacctacccccaccccgagcttgcctcaagacccagcatggacagggccgcctacctgaaggtgtgggtggcggagggctaagacatttgggagggctatgacattccgggacctttaaattctttctctctagggcaggatcataactgcatacacttctaatggggaggggacctggggagtgtgactccggtgtggcccagctctgagctgtgcgggaggcatccctggggtcaggggcctcacaggttcacccaggggagcacaggctgcggaccctacaacgtgggttgcgaagagtatattttggatattttcgcaaaaatccaggaggaagctgtcactcctggttcaggcagccccgccttccccagtgtggatcggctgccgggctgcggggaatcccacgtgtgtgggggagggcgtgtccgcagaccgtgggcaccagctggccttggagagcgctcggccggtcacctccctccttctcccttcttctaggaaatcagcagtgccagggagtggaaggggcagcgcccgtgccccggcgtgcagggtgcgcccgccttccctccctccttccagcgttcgcggtcctccttccctggcagggaccccgcccccgagcccgcccccgcacggctgtgcgtcctgccatgggtcccggtgccaggccccgccgcccactgccgtccacgccccgccggccgccccggcgcctccgccgcccgctcctcggacccgcactgccagcccggcacctccaggcgagccccgcaggccccgcgtccgagccgagctggggacgcgcgggccgagccaccccgcccctgaccgcggcgcctccgctccttccccggctcacctgcccagccgcatggtgcgggcggagacctcgggccgcggagacctcggggcgcggagacctcggggcgcggagaacttgggccgcgggagacctcggagaggagcaacctcggggcgcgggagatcggctctaactgcgctcccgccgcgcccgaggctct

SEQ ID NO: 98 - DNA, 3249 bp, Homo sapiens
  ICOSLG CpG Island
tgtggcccagctctgagctgtgcgggaggcatccctggggtcaggggcctcacaggttcacccaggggagcacaggctgcggaccctacaacgtgggttgcgaagagtatattttggatattttcgcaaaaatccaggaggaagctgtcactcctggttcaggcagccccgccttccccagtgtggatcggctgccgggctgcggggaatcccacgtgtgtgggggagggcgtgtccgcagaccgtgggcaccagctggccttggagagcgctcggccggtcacctccctccttctcccttcttctaggaaatcagcagtgccagggagtggaaggggcagcgcccgtgccccggcgtgcagggtgcgcccgccttccctccctccttccagcgttcgcggtcctccttccctggcagggaccccgcccccgagcccgcccccgcacggctgtgcgtcctgccatgggtcccggtgccaggccccgccgcccactgccgtccacgccccgccggccgccccggcgcctccgccgcccgctcctcggacccgcactgccagcccggcacctccaggcgagccccgcaggccccgcgtccgagccgagctggggacgcgcgggccgagccaccccgcccctgaccgcggcgcctccgctccttccccggctcacctgcccagccgcatggtgcgggcggagacctcgggccgcggagacctcggggcgcggagacctcggggcgcggagaacttgggccgcgggagacctcggagaggagcaacctcggggcgcgggagatcggctctaactgcgctcccgccgcgcccgaggctctgagcgcccagcgcgcggtgtgctggaggcagccgtgtccccgccccgtccccgccccgcccccggcctggctcctctggcgaccgagaccgccccgggacaggaggcggggcgctgcgcggcggctccggaaagttcggctctgcccaggcgtgtgcccgtcggccggaggcgggacagaggcaggtcggcctgtccgcctggacgcggacctgggcgccgtaggtgccctgggaagcgcaggggtggggggtacccggcaggaaggtggccaggggtgctgcgggtgccggcgcagcgagggagggcaccgtgggaggcaagggccgttccccgcgccgcgcacaatgcgccggtcctgcggccctccccgagcaggagtccggggacccaggccccaaggctgggagagcgccaggcccctggccggctgcgctccgatgatctccaggacttaaggcgagtgagctcagcgactgctgaggaatgaatgactgaatgaacgcatgcatgaatggaaggagggagggaaagtgggcgggctctaccctctgggccagccccagcccgcccccacctagccttgctcccctagccttctaggggtgtgaagggcgctggcgcagcctctttgcttaacactggctctgaggatcccccgccgagaaaccgaggcaggcttgcggctctgggctcgtcagccttggcagtggcgtctggcctggagtctggggcagctggtttgggaaaggctgcaccacgcaaccgagggtgggacccagagtccctgctccttccccaccgcacccagcccaccccgccctccctccctgatccctgcaagccaggtgaggcccaggggggacgtgactccctttctgcagaggcacctccggaagggcctgggtgaggctgctagacagggcagcggggcaccctcctcccggagcccccgcctctgggctgaggctcggatccccaccgcctcctgcgcatggaggaggcgagaagcgcagggagacgggggccccagacggcaccccgcaggctgccattccttcaaccaagatgtagagaacgccgtggacaaaagctttaaaaaaattctgaaacctctgcccgtgggaagtcaacatttttgcggagcagagagcccaggcacaaaataagaaggcggaagagacgggctggggggataggggggacggcggcggggaagggcagggagggcggcggcgaaggcgcaggaagccctgaagccgggcggcttccccctcccaggccacgctgagagacgggggttggggggatttaaaatcgcgcgcctggcaggggcggggcgggggccacctgccctccggcgggaagagctgggcagggcccgcggagtgcagggcggaggcactggcggtccgcacccgggtgaggtgaggcgcgtaaccgcatctgagccggactctttaggacgagtcccgtccctggagtcagaaaacccggtccagcgccagcgtggacgtgcgcttcccgggacacgcccagggacgccggctaggaccggcgaggctggaggggtggcgatgttgggggctgaggttcctcgccccggggcgggcggctgctggtaagggaccgcatggccccgcaggtgaggagggcgcaggtgaggagggcgcaggtgagccgggcgggctgcgggcagcgccacctcctcccggaggccctccctgattgaccggccgggaaccgcgcgcctctgggcctgcggctgaggtccggggctgcgccgcgccgatgagctgacgccgggccgagcgctccacccccagggccgggcgcacctgaatcccctccacccgcgggactgcggagagggggacggcccccggataccgcgtgggggctttgggaggatggggaatgggtcctgggggagcagagcctcccaaattaaggcctcccaagagcgcggccggtcatccgcggcggcgaagggaaggtgccctgtcggtgcgtccggaccccgcagccccccagtgccgcccgggggcggtgggagaggggccgacaccgcagggcccgccgtgctgtggccgagggggcaggtccaggctctgcttcccgggcagacgccggagaccccagcaagccaagtgctgcgggcagccccccccccgcccccccgagagaggggacgccgcgtggaggccacagccaggcaggggcaggaaggcagctgggccagaaggggacactgaggcaggccgaggcggccgcgggggagggtgccaggaccagcccaggaacctcggagaccacggtaagcggtggctggttcagatcccaactccggagctgtgtgaccccagaaagttccttagccccttggtgcctgcatcccctgacgtgtgacatata

SEQ ID NO: 99 - DNA, 9070 bp, Homo sapiens
  ICOSLG Promotor
ctggggagacggagaacatcaggcgtgcccgtgacagggtcaggtgagtgacgggacagccctgtgcggaacgcggatcattttgaaaccaaacctgagctcctcctgtttcagatcctgctgcagctggtgcccctgcctcgggcagcaaattcccctcgtgactccaatgcccctgccatcttgggtctgggagcctttgcaccctgcacgccacaggctcgccacctcctcccgccagcccccaggatgccttccccacgtgggggcccttagtggccgggaccactttggtagcagtgcttaccccagccccccaaaccatcagtttctggggccagctccccatgaagcaagagccccaggagcagggacatctccttctctgatgtccctgcacctccaaggtctgggagacgctcatccctcttctctgtggcctctgcctgggaaagcttgggggctttgtaagtcaaaggttggtcttgtgggaacctcccagtgggctgtccctgagccctggagccacagaaacccctgccccacccacgatggctgtcatctgagtctgcatggaggtgtgtctgtgccaagtgagcacacatgcaccaaggcggcccctggccaccaggggctcttgaagtctgcaggcggcccttcctctctctcccactccccctgttggggccaccattctggctggcaagatggctgtgatggcctccagcaggccccctgcctccacccttagccccttcaagcatttccccagagccaccatctaaacgacagctgtgagaactcctctgtgcccccatttgtctcccacagtgcccatattcatcaccagcccacaaggcccctcctgtctatggaggcctcctcaggacatctgggggcttcctgggccagggtggggggtgcctgctccaggctgtttctggcttgtcccctccctgggtgctgcctaagcagcggcctctgtgtcctttccttggaccctcagcacccctgcatctaacctacccccaccccgagcttgcctcaagacccagcatggacagggccgcctacctgaaggtgtgggtggcggagggctaagacatttgggagggctatgacattccgggacctttaaattctttctctctagggcaggatcataactgcatacacttctaatggggaggggacctggggagtgtgactccggtgtggcccagctctgagctgtgcgggaggcatccctggggtcaggggcctcacaggttcacccaggggagcacaggctgcggaccctacaacgtgggttgcgaagagtatattttggatattttcgcaaaaatccaggaggaagctgtcactcctggttcaggcagccccgccttccccagtgtggatcggctgccgggctgcggggaatcccacgtgtgtgggggagggcgtgtccgcagaccgtgggcaccagctggccttggagagcgctcggccggtcacctccctccttctcccttcttctaggaaatcagcagtgccagggagtggaaggggcagcgcccgtgccccggcgtgcagggtgcgcccgccttccctccctccttccagcgttcgcggtcctccttccctggcagggaccccgcccccgagcccgcccccgcacggctgtgcgtcctgccatgggtcccggtgccaggccccgccgcccactgccgtccacgccccgccggccgccccggcgcctccgccgcccgctcctcggacccgcactgccagcccggcacctccaggcgagccccgcaggccccgcgtccgagccgagctggggacgcgcgggccgagccaccccgcccctgaccgcggcgcctccgctccttccccggctcacctgcccagccgcatggtgcgggcggagacctcgggccgcggagacctcggggcgcggagacctcggggcgcggagaacttgggccgcgggagacctcggagaggagcaacctcggggcgcgggagatcggctctaactgcgctcccgccgcgcccgaggctctgagcgcccagcgcgcggtgtgctggaggcagccgtgtccccgccccgtccccgccccgcccccggcctggctcctctggcgaccgagaccgccccgggacaggaggcggggcgctgcgcggcggctccggaaagttcggctctgcccaggcgtgtgcccgtcggccggaggcgggacagaggcaggtcggcctgtccgcctggacgcggacctgggcgccgtaggtgccctgggaagcgcaggggtggggggtacccggcaggaaggtggccaggggtgctgcgggtgccggcgcagcgagggagggcaccgtgggaggcaagggccgttccccgcgccgcgcacaatgcgccggtcctgcggccctccccgagcaggagtccggggacccaggccccaaggctgggagagcgccaggcccctggccggctgcgctccgatgatctccaggacttaaggcgagtgagctcagcgactgctgaggaatgaatgactgaatgaacgcatgcatgaatggaaggagggagggaaagtgggcgggctctaccctctgggccagccccagcccgcccccacctagccttgctcccctagccttctaggggtgtgaagggcgctggcgcagcctctttgcttaacactggctctgaggatcccccgccgagaaaccgaggcaggcttgcggctctgggctcgtcagccttggcagtggcgtctggcctggagtctggggcagctggtttgggaaaggctgcaccacgcaaccgagggtgggacccagagtccctgctccttccccaccgcacccagcccaccccgccctccctccctgatccctgcaagccaggtgaggcccaggggggacgtgactccctttctgcagaggcacctccggaagggcctgggtgaggctgctagacagggcagcggggcaccctcctcccggagcccccgcctctgggctgaggctcggatccccaccgcctcctgcgcatggaggaggcgagaagcgcagggagacgggggccccagacggcaccccgcaggctgccattccttcaaccaagatgtagagaacgccgtggacaaaagctttaaaaaaattctgaaacctctgcccgtgggaagtcaacatttttgcggagcagagagcccaggcacaaaataagaaggcggaagagacgggctggggggataggggggacggcggcggggaagggcagggagggcggcggcgaaggcgcaggaagccctgaagccgggcggcttccccctcccaggccacgctgagagacgggggttggggggatttaaaatcgcgcgcctggcaggggcggggcgggggccacctgccctccggcgggaagagctgggcagggcccgcggagtgcagggcggaggcactggcggtccgcacccgggtgaggtgaggcgcgtaaccgcatctgagccggactctttaggacgagtcccgtccctggagtcagaaaacccggtccagcgccagcgtggacgtgcgcttcccgggacacgcccagggacgccggctaggaccggcgaggctggaggggtggcgatgttgggggctgaggttcctcgccccggggcgggcggctgctggtaagggaccgcatggccccgcaggtgaggagggcgcaggtgaggagggcgcaggtgagccgggcgggctgcgggcagcgccacctcctcccggaggccctccctgattgaccggccgggaaccgcgcgcctctgggcctgcggctgaggtccggggctgcgccgcgccgatgagctgacgccgggccgagcgctccacccccagggccgggcgcacctgaatcccctccacccgcgggactgcggagagggggacggcccccggataccgcgtgggggctttgggaggatggggaatgggtcctgggggagcagagcctcccaaattaaggcctcccaagagcgcggccggtcatccgcggcggcgaagggaaggtgccctgtcggtgcgtccggaccccgcagccccccagtgccgcccgggggcggtgggagaggggccgacaccgcagggcccgccgtgctgtggccgagggggcaggtccaggctctgcttcccgggcagacgccggagaccccagcaagccaagtgctgcgggcagccccccccccgcccccccgagagaggggacgccgcgtggaggccacagccaggcaggggcaggaaggcagctgggccagaaggggacactgaggcaggccgaggcggccgcgggggagggtgccaggaccagcccaggaacctcggagaccacggtaagcggtggctggttcagatcccaactccggagctgtgtgaccccagaaagttccttagccccttggtgcctgcatcccctgacgtgtgacatatacatgaatggggctgttgtaagtgaacgcacacagcacaccggcacatgtgtcacaacacttagatgggtttagatgaagaaacagggaaacctttgggaagtttcctgtagtcaaaggaaggttttcgttttccccctcaaccgtgactgtttcttgggccggcaggataggcttttgttctaggggtgtggagagagggccccttggcagcgtccagggccaactgggaaccaagcaggaatcgtatttgtgcagcctggagttcgaggctctgggtgcgagtcgtagtgcttaagcaggaagcagctgcctgatgcccctagccccaggccgccctgctctgccgtttcgagggcgtgggggtcttctgatctccaccttgatgcacctccaggcccgggtccttttggggtctggcacagcaacctgcgtttgacagcatgggcgtccgctgatgctgagagctcaacttctggtccaaggaagatcttttctcttcggggaacagtcatacattgtttaacgaaaaggatacattccttctgagaaatgcgtccttaggtgattttgtccttgtgtgaacacagagtgcacacactggccctggtggcacagcctgctacacgccgaggctgtgtgtcacagcctgctgctccagggccacgagcctacgcggcaggtgactgtgctgaatagcgtaggcagctgtgactcactggtatttgtgtatctaaagccatctaaacatagaacaggtgcagtaaaaataccgcgctgtgatatgggagcactgtggcattgcttgttgaccgaaggttatgtggtgcatgactgtatgttcgtttcctgtgggcgctggaactaacgacctcacgcttgctggctcaaaacaacagcagtctattctctctcagccctggagagcggaagcctgcctggtggaggcgctaggggagtatcctacctgcctctcccagctctgggtggcccaggcatccctgtgcttagctccagcagccgcctcagtggccatgtggcttctctgtgtggtcaagcctcactttgcccctctcttatgaggacctttgggatgacacgtagaacccacctggatgatccagggaggccttccacctcaatttaatcccgtcagcaaagtccttcctttgccacatgaggtaacattcacaggatccgggaatggggacatgggcatcctttggagggtggttcagctgagcatgggatcatgatacaggtcctgtgtataaaattcaaatacttggcaggtcgggcacagtggctcacacctgtaattccaacacttagggaggccaaggtgggaggatcacttgagcccaggagtttgagaccagcctgggcaacagagcaagaccccatctctacaaataatttttaaaaattagcagcgcatggtagcatgcacctgtagtcccagctactccagaggctgaggctggaggatctcttgagcccaggagacggaggctgcagtgagctatggttgtgccactgcactccagcctgggggactagctagaccctgtctcaaaaaataaaaatttaaaataaaatacatagagaatctcaaggtggtgtggacagttctgagtgttggggagagaacaaaagaaggaaagtgcattttgggtggcagaaagcccctaacagagccttgggcccctgctttgaagcagccctcacagaaactgaccacgagttatgttgggcccatgacactggttccctgggtggacacagcctgagcccagcccgccctgtctggagctctcaccaccctgcctggcccgtgcccatgggctcacaatggcttcaaccccatttatgtgtcagctcaagcaggcctccccagagggctcatttgcacttggatgccctcacctgtgctccctctgtggcttcaggaaccccggggtcattacagagcttgctaaattcatccctggacgtgagatgtgtgtcgtaagcatccaggactgtcccaagatgggagaggcgttcagtcatgttcactcaagtgaaggcttctattctacttccagatacacctttttaaccttcaaagggtccaattttaacctttcttccacaaagcattttacgtaccactaatagtcccagtgcagaccccaaagttcccctgtaagattcatttcctgtgattcgagcacagcctgaggcagagctttctgctgggtttatcctcactgagactcagactgcagagggccaggaggagccctgctttttgcaagcaataccacctggggtaggacccacaagtgacatcctttgtgcgtggatctggccttggcctccgcaccgtctgttcagcaagtccctcctttgcctgccaaggctgaggtcctgtacttttgtgtgtggatctggccttggcctccgcaccgtctgttcagcaggtccctcctttgtctgccaaggctgaggtcctgtacttttgcaaaggtccaggctgtttggtgcagctacaatcagggtgcgtggtttctctatgaacgcaaacagcggtctcaaggggaaggccccggcagaaagtgcatcatgcgggacacggtgcaggcgctccgaagacgcctcctgctcacttctggcctccaccccctgccctgcagggtgacagatggctgtgcctacacataaaacaccagacgtgaccaataactatcttataataaatatactcgaacttctcaactagaacacagaaatgctttcaggaagtacatcgcgcaccaccacgtgtggtcctgtgtgcagcggcgtgggcctcgccccgtcccatgagccagcgtgatgggggagagaccctgagtctccagaacccaacggaacgtgggtctgcagtgacgacggagacgcaaaaaaacaagaatccgaagaggaaagagacaacgtgaggaaagttgcctttgttctaggaaaagtctttttcttcacagtatagtgactcatttataaagaggaagtgagttctgttgaaaaatacttgaaatattctcttagggggagaaagcagttcttcaccagcttggtgggccacttggccgcgagcttcgagctctgcttgttctgggccagcagggacaattcttcttccgaaaccagagcccagtgcctgctgctgagaggaggggagggaaggttgtgagcaagcgcagcgcccactgggtggccccggagatggggctgggaaggaatcgctgcgagggggcgaggggaacagcctgcctctcagttgtcccaggtgcctaagaccccccccccggaacccccgcctgattctgggagtttttctcatggaggtggagtgagcaacaggggaccagatgactcccttgcctcccgcctcccccggccgggggctggtcccctgggaagcaggctgggggtcactccgtgtgaacagcgagctccagggccatcgctagaggatgtcaccatccctgggcagcacccccgcagaggaaaggacaggactctgggcaaaagttggccaaaccctcgcagagtcagcgagcattcccagggaattctatcacaaaggccgtcccctgggttcctggggctgcctgtgccgggagccccagccctgggtgcaggagggcaggtggtgagaggaaaggtcccctgccagcctgctgtgaggagcccttgaggaagacgggctttgcagacttggcaccaacaccccctctcctgctcccagccaccccactggaggccaggaacatttctcagtttattttggggtgaagactgcgagtgaagtgccagatacagtgtccccctcctcctcctcctcctcaggcaccctccctagggcagtggggactgtccttaaccatcctgggggtgatggtggctacctctgcaaaaggatttctcctttcagtgagtgggtgtctctcatgtcactgttgagacacccaggagcctgggagggaaacctgtgggaaggaactgccagcctccttctgggaaccaggtgaccccaggatcacggctcaggtggatccagccctcgaaaccctgtgaggagctctgtggagcctcgctcagaaaggggggctgggaagaagcagctgccagcccacagcccaagcctgcaggggccacaagtgtggccactggagcagagggaggtgccttttgtggagcagcaaccctgggtctggctgcacctgccacttaagaaccctgatggggcgctgttctcactgctgtgtggacgcatagagcctccgggggccaaggagcctctggggccaggcagcaggtgaggcatggcctgtaatgcacacaggtgttgctgggtctgcccccaccttcacccccgctcacccagccccacagagcctggcatggcctcccaggaagtgacatggcggggaacaggcttagggttagggggaggctgtgcgaaggctggcatgcaggtgagagggcttctgaagagaaagcatgctggaaaagtgcttcggctcagccccacccaaactcaaatccaggggaagccaggccagcaagacctgcaggtgccatgc

SEQ ID NO: 100 - DNA, 13037 bp, Homo sapiens
  ICOSLG Enhancer
agtggtgtgatatcagctcactgcaacctccgcctcctgggttctagcaattcccctgcctcagcctcccgagtagctgggattacaggcacacgcctccatgcctggctaattttttgtattttagtagaggagacagggtttcaccatgtggctgctctttatacgctgattataatgtattagcatgctaagagacactctcaccagcaccacgacagtttataaatgccatggcaacatcaggaagttaccctatattgtctaaaaaggggaggatggccagatgcagtggctcacgcctgtaatcccaacactttgagaggctgagatgggcaggtcacttgagaccaggagtttggagaccagcctggtcaacatggcaaaaaccctatctctactaaaaatacaaaaattaaccaggtgtggtggtgcacatctgtaatcccaactacttgggaggctgagacatgagaatcttttgaacccgggattcggaggttgcaatgagccgaaatcacatcgctgcactccagcctgggtgacaaagtgagacctgtctcaaaaaataaataaacaaaaaacaaataaaggaggaaccctcagtttcaggaattgcccacccctttcccggaaagctcatgaataatttaccccttgtttagcatataatcaataaataaccgtaaaaatagccaaccagtagcccatacttctgctctgcctatggagtggccatttttcttattcctttactttcttaataaacttgctttcactttataaaatcgtcccaaattctttctggaaggaggtccaagtaccgtcttggggtctggattgggatccctttgtggtaaaacaacccttccgtaactgctgttaatgggaaaaaacagactctagaacattttacagaggtttattctgagcctgtacatgtgactgtggcctggagagaagcaaacccaggaagccttgagtgagtcgccccgaggcggccgggttacagcttgactgagtggccccgaggcggccgggttacagcctgagtgagtggccccgaggcggccgggttacagcttgactgagtggccccgaggcggccgggttacagcttgactgagtggccccgaggcggccgggttacagtttggttttactcatttcaggaagacacaagttacaggccaagacataaatcagaatgtggaaggtgcacactgatttggcctgaaaggcaggagatcttggagcagggtttacaggtcataggtaggttccacgattcttttttttttttttttttgagactgtgtctcactctgtcgcccaggctggagtgcagtggtgcgatctcagctcactgcaacctctgcctcctgggttcaagtgattctcgtgcttcagcctcccaagtagctgggattacaggcgcccaccaccatgcctggtgaatttttgtatttttagtagagacggggtttcaccatgttggccaggctggtcttgacctcctgacctcaagtgatccgcccacctcggcctcccaaagtgttaggattacaggcatcagccactgcaccggctggttctgcgattctttagttgacggttgattgaaagcgtgaagctttgtctacagaggtgaagtcagctggaaggaaggctggaattaagatgaggggtgtgggggccgaggcccttggtttgcagatgaagccttgtagattgcagccctcagagagaatagatggcaaatgtcccttttcagaccttaaaggtgtcaggccctcagttaatctctcctaggtctggaaagtactagaagaggaagtcctggctgcattcgtggagattctctatgggtgctagtttctctgagaaaggatggttctgtgggaccctttcaaaatatgtcaaagaaatatattttaaggcaaaatattctcatttccttcagagtctgctatccgtcacgtgatgctataccagagtcaggctggaatttggtgtcttattgccacatagagtgtgttccatccgtcttaggatcctgattttaatgtcaggactggccagctgtgcctcaactctgaaagggagggttgtggctgtaaccagcaaaggtctggctgctcaccgcttaaaaagaagccacgatgacaagagtggggcgtgatagaaagagagtgagctgccgggcgcggtggctcacacctgtaatcccagcactttgggaggccgaggcgggcagatcacgatgtcaggagatcgacaccatcctggctaacacggtgaaaccccgtctctactaaaaatacaaaaaattagccgggcgcggtggcgggcgcctgtagtcccagctactcaggaggctgaggcagaagaatggtgtgaacccgggaggcggagcttgcagtgagccgagatcacgccactacactccagccggggtgacagagcgagactccgtctcaaaaaaaaaaagaaaagaaagaaaaaagaaagagcgtgagcttcattctcatgctagcaagggggagattggccggaatcctttccaaaaatggccactcttcaatttgtagagggacgtgtagagggggtctggaatgcaggcgaggcaggggccaggaggtgccaggtgacctgctctgatggcttctcttgagttattgttccatctgttacagtaggcagctggtcagacatgagcagggcaggagagggccctcccaaccaggaatgtcaggcgaccatcagtgttggtcgggtggctgttaactgtctctctaaaataataattggtcacagccaacgccagggaaaggcagcctcccaacagacagaaaaatccttccccataagacctcaggcattgggtgagtgggctcaagcatgtgtattaaaaggcaaaattgtggagtgtaactggtctatggcctcctagggacatttgacaggtaagggaacaacgcctcaggtaagcaggcgcgcaactccagtaaacacatagcgcgtgctcctcccaagggctggcagccactgcacatgtggacagcccaccccaagggaagaatcaggggagaaggcaggccagaccccggaagcgtgccaacatataaaaccccaagtcgaaggtcaaaccacacacctgtccttcaagtcacctgcttggcccccttccaagcgtcctttccttcctttcattcctgctctaaagctttttaataaatgtcactcctgctctaaaacttgtctcggtctcttcttctgccttctgccccttggtcgaattctttcttctgaggaggtgagaattgcggctgccgcagacctgtacggatttgccaccgatcacaggttttggtgccgtgtcacttggataacttccaccacaaacacatctggtgaaggggctgcgccatcgcgggtcgcccccagattagaaatcaatcacagtcaatcttgcagtgagtctttagccaggagtaagctctggcctcaaagtaacccgcctgctggggaaggaattctggagatgcctggttcgtcccaggatctggcccccaaagcttctaggaaatagatgaccagacaggtgagcatggtgtgcactcagcaagcatccagataaacaaatgtgcacagggcccgggagctgcaggtgggagagggaaggcagtaggctcacagcttgctcccaggctggatttcaagatgaaaggaagcacatctgtagtttgctcaaagccatgtcttgagactggggagaaaggaggaaagaaaggccgtgttaaaacacagttcgaagctgagctgctcggtgacataacgaggcctgtgcgaccacccaggaggaggtttttcaggcttctctggggtggacatggccaagcgggggtcacttcagttggctggggacttcgggttttatttttggtttacactggcctgggatggaactgggcagttctaatgtgactgggtgtgtactggtggcttcactcacccagggcaggcaggcacctggaaccacgactcagaaagaggcaggaaggtggagtgagaagatggagctattaggggcgtggcaggggcaggtcaatcaccctgaggcttcggggagtttcctggtctccagaagggcagtgtgctcaccctcccctgtgcatggtgttgttaagagtgttatcaggagtgtctgctgagctgtgactttgccgtgccatgcaaatactcacaggcagcactactgtcaggaagatggaggctgggccgggaggcttgctttcaaggccacgagtgtcaaacccacaaaccgcagagcagaacagccttggccaagcagatgaggagggcctcatcctccatctcccgccaccatcctcttcccaactgaagtcagaggcggggaggtgggaagtcctgtcagaggcagggaggtgggacgccctgggccagacagatgatccaaagcccttggttttaggtaccatctcttcgatgtttcttggctgagtaaaccagcccaatctcttttttataaaatgagaccacaggttggcctgagaatggagaggagtgaggaatctagctgttctggggccccgggctgttcagaatccattgtaaaccattggaaagcaggtttgtgtatttgtttaactgcatcttgtggctggtcattgtctctgtctaagctctcacccagcccggctgccttccctgagtccccacctgacctgcacaactgctgaggacgaaagcctgtgtccccgacatgcacgggagagcagtgtcttcccaggccctagagtgcctggctgtgtgggcagccccagggcacagtcttctaaagaacctcattgagggtcgggggtcgggggagtgggctccagggtccactcccaaccttacagcttttacctccggaatccccaggcttctgtcaggagggtgcctgagtggcttacaacaagaactttgcctatccctttactgttcgcaaaacaccatctcaaaaatcagtcaacatggattccaagttttgccttaggccacactggatggagttgcccccggctggaagacaggacctttatccccagtgccacaggaggattcccctgtgtggcctccccaccggctgtgccctaagatcagtgctgtgtgcacagcccagcagaggagcccaggagactccagcaggcagggagctgctgccccaggagcacattccagcatctggaaacacctcccactgcagctgcaggggaagtgcctggaagagaaggaaaagaaagaggaggaggaggaagaggaggaggaggaggaagaggaggaggaggaggaggaagaggaggagggtcgtgcccacgctcatggcaagcgtcaccctggagctttctgtctcagtccaagcacatccacctgcccttcctcactgcattctcccaggggcccctggctgcacacaggcatggcctgcatttgcatagagggtctgggcccttggtggagggcctggcctgccccatcttgggtcctggcccagtgttgtggctgccaacctgccctcagagcttcacgggaaccaagggctcaggctctgagtggagtccgggtgggcctgggcagcctttgccggagaggctccttcctgacatggctctgctggaggagaaagtgtcagttcctctctcaggccctgtagacaggtgtccaggtagacaggaagttccagaggtgattttagctcagtctgttacttttctgctggcaggctggctttactgtggttgtccctgtggccgttggctgatgttgctgaaattccagggctctggagtgtccacatgtccacgggatgggaagcctgttgcagaccagccaccatgtccctgcggctcaggaccacgctcctgaagcccagagtcctgccctgggagcaggtctcagtcaggactgactcctgagaagaatgagaggggaagtgcctccaggccgggatgccagctatagcagcgccctccagcaacgtcctggaggaagcacctcattcgtgccaaactcactgattctaattcgtcatcgtgattcttcacaatgaagaaaaactccaagccagtgccttcctggggcatggcaggcctccctctggtctgagcaggcagctgtgcccagacctgggctcttccgaaggcatgtgactcccttgcacacagccgggttctgcttgatgcttcttcacggtggaggcagagaggttcccggggttaccccatcgtcgataatttcatcgttgatacttttttttttttcagatggagtcttgctctgttgcccaggctcgtggcgcgatctcggccactgcactgcgctgcaacctccgcctcctgggccacgagtgtcaaacccacaaaccgcagagcagaacagccttgttctgctgcctcagcagccaccatgattctcctgcctcagcctcccgagtagctgggatgacaggcacccaccatcatgcctggctaacttttttgtagttttgtagagatggggtttcgccatgttggccaggctggtcttgaacgcctgacctcagatgatccacctgcctcagcctcccaaagtgctggaattacaggcgtgagccactgtttccagcctttgttgatactttctaaaccatccctcctaagcccgggtggcttgctgcctgcagggctcctgacctcagtggctgactccccacacccgactccagcctgtcctccctgcctgcttacctggccgggtttttcccatttcgatccctgcagaggacaaattaaagtgaagattgtcacctgtgggtggcttgggagaatgagaggcagagagggtcaaagtgattgaattctgggttcaggaaaaagggatatgggtaatgtgtaaaagaagaaaaaaatacagatgatttggttaaaagcaattcgatcaaacacaaattactcaaaaggatttcttggcagaaatgaaagattatttgaacaataatgttcgacaatatccaatctctatctggtaattatctggatttatccaaccatagggtattatttctaaatacctaaattaggggaatacctaagaaaaatgttatcttgacttttttgttgttgttgagatggagtctccctctctcacccaggctggagtgcagtggcgtgatctcagctcattgcaacctttgtctcccggttttaagcaattctcctgcctcagcctcctgagtagcttggattacaggcgcccgccaccacacctggttaacttttgtatttttagtatagatagggcttcaccatattgcccaggctagtctcaaactcctgacctcaggtgatccgcccacctcggcctcccaaagtgctaggattacaggaccgcacccagccaattgacaaattatttttaatttttttttttttttttttttagacggagtctcgctctgtcacccaggctggagtacagtggtgccatctcggctcactgcaagctccgcctcccaggttcacaccattctcttgcctcagcctcctgagtagctggaactacaggcgcccgccaccacgcccggctaattttttgtatttttagtagagatggggtttcaccgtgttagccaggatggtctcgatctcctgaccccgtgatctgcccgcctcggcctcccaaagcactgggattacaggcgtgagccaccgcaccggcctgtttttaatttttatttatttatttatttatttagagatagggccttgctctgtcaccgaggctggagtgcagtggcacaaccatggctcactgcagcctcgacacccctgggctcagctgatcctcccaccttagcttcctgagtagctgggattacaggcacatgccgccacaaccagctaatttttgtattttttgtagagagagggtttcacaatgttgcccaagctggtctcaaacgcctacactcaagcgatcctcccgtcttggcttcccaaagtgctgggattataggcgtgagccaccatggcgggctgacaaattagcatataaaatatgacttaattgtggatttttatagttatggaccctaatgggcataatgaaagttatgtatggaagcacacctcagagcaaaaatacttagagtgaaccatggtaataaggcttcagagtcctttatttatgtatttatttatttgagacggcgtctcactctgttgtccaggctggagtacagtggcacaatcacagctcactgcagcttcgacttctcaggttcaatggatcctcccgcttcagcctcctgagtagctgggactacaagtgtgcgccaccatacccggctaattttttaaaaatgttttacagagatggggtctcaccatgttgcccaggctgagattatttttattaaaaaaaaaaagattgcaatatgaactctctcccttcctaaacagataatgcagacttttttcctttcaaatgaagaggttttattggaagttgcatagagaacacagtcagtcacgagagcagaaggagcaggttccaggattctggggagataagggtccaagctgagaactcccctgagaagtctgtatgcagacagccccgggtgatcctggctgtccaagggctgagggcgggttgggaagggccctcatcaccccaggggccagctccccacatagcagctgagtagcacccagagaacccggatcttcactcaaggtggctggcagcagagccacagcccaggccaccaaagccaccagagcccctgtgtggcaaggatcatgatgcgagggtggtgagttggttgctgttctcagcaggatcctgggtgtaaatggccatgcctgtccagcacggcttatggggctgagcatgtgagaacttgtgtggcctgtgcctgtgcaaacgcgtgtgccctgggtatcacacccagagccctgctgtgtgaagaagcctcagtcatcacgtgtgagctcacagtgggctggtcatggggccccttccacatggtgcactgctgctgcaggaattgctgtgtctgcaaattctggacataccagaccctaaatagaatgctgggagcaggcaggttacagaagcctctgagtgcggcagctctatgggaactggggtgcttcacttacaagtatttgaggtattacaatgtatccaattttttttttttttttttttgagacggagtcttgctctgtcacccaggctggagggcagtggtgcaatctcggctcactgcgacctctgcctcccgggttcaagcaattctcctgcctcagcctcctgagtacctgggattacaggcgcctgccaccgtgcccaactaatttttttctttctttctttcttttttagtcagagtttcgctcttgttcccaggctggagtgcaatggcgccatcttggcccactgcaacctctgcctcctgggttcaagcaattctcctgcctcagcctcccgagtagctggaattacaggcatgcaccaccacacctggctaattttgtatttttagtagagatggggtttctccatgttggtcaggttggtcttgaactcctgacctcaggtgatctgcccacctcagcctcccaaagtactgggattacaggtgtgagccaccgtgcctggccaatttttgtatttttagtggagacggggttttaccatctcggccaggctggtcttgaacccctgatctcgtgatccacccacctaggcctcctaaagtgctgggattacaggcatgagccaccgcacccggcctgtttattttgtttgtttgtttaactccccctgcacctccgccaaaaaaaaaaaaataaaagaaaaagaaaaactaacctgtaactctgaagtgtctggtagccaggtgcggtggctcgcacctgtaatcccagcactttgggaggtcgaggtgggcagatcatttgaggtcaggagtttgaaaccagcctgaccaacatggtgaaaccctgtctctactaaaaatacaattacctgggcatggtggcgcacacctgtaatcccagctacttgggaggctgaggcagaattgcttgagttcgggaggcagatgttgcaatgagcagagattgcactccagcctaggtgacagagcgatactctggctcaaaaaaaataaaataataaagtctcttgcctttggagtcgggcatgaaatcttaatccgtgagttttctacctgggccatggtgggccactgaccaccttcggcctggatgaaggctggcccccagagggttgccaagctttgccagtgctccctggcctgcgtggggcctggctgagggcgagggcaacaggaatgcattgtgtctggggctgagcaggacttgcggtgcctgggccctttgagcctggtgactcctgagtgtgactcctgagtctgaccccatcacccgtgtgggctgacaccagcaccttccacgctgtgcttctgtgtttgccgccggtctccaggagtggccgcttctccatcaaataatactccagtcttcacgcccatggcttcccccagaccccagcccagcccgagaacaaacgctccattttccctcccttacagctgcggtggttgccaccacatggaaggcccagaggaagggaggtctggagtggcctggagctgtggcctccccaggctacggccagacccaccaggaggaagccccttgcaggctctaaggttaacgccgccaaaccaagtcctgatcctgagaggctggctcaggatgaggatgggcggtggtgtcatgcacaggcacctgaggtccctggctgctgtggcacggagaggcccccacggaaggactccgcaggtgctggagctcgctccctgcatggacagctgcagcctgggcagggataggggagcaaagctgcaggcccggctcatcatggaaattcagaccggtgagccatggaaggacatcgccaagtccatgtagggtgagctggggacagcatggggagtgggaggggggacagtggggagaggggagagcggggtgagctgggtacagcatggggagggggacagtggggaggggggagagcggggggagcctggggacagcatggggagtggtgggggtgggggaaggtggagggagggcagtgcatggaggacagtggaagagggaggcagtggtgacagtggagagggaagacagtggggaggtagaagggaggagggtaggacagtccagcccccattggcaggggcagctggggagagcaggccccgcctttgtgtgccccagggcctgggcctgcctggttaagagtctgcacactcctagagctggagcttctcaatgtcgctcttggaaggtgaccccacactccgctggggataatgcagggggcccaggggtcctccctgggaaaagtgtgctgtgccccgccatagggttcgtggcagaagcccctcccctgagctcaggcctcacctccggccactgaagacaaggagatgcagagaggaggcctctggagtcttgccccttacccctgcacccctgcagcacaggcagggtgtggtggccgtcttggaggcacccgggcctggacagctattccaaagccatagctgccctccccagggtgggtcgcttggtcttaggagcgtccaagctgcagagcccagtagacagaacctggatccagcgcctcactttacaggaggggaaactgaggcacaagcatgtgctacctggctcgggggccagcaggcagccttttcccttctgtcacctgccctagggatggaccgccccatctgccagccttgactggagcctccctggtggatgtttaccgcacacctactacgtgcagggtggtgcagctggcgagagtcccctctcctgttccacagaccggcaaggttcccctgagccctggggcaggcaggacctttggctggaggtgggtgtgcagggcagggtctctgaggggagacctcagactgtggacttgcgggtggacgcttctctctgtcggggcctcccgtgtccagaagatgttgaacagcatctgaggcttccacccgctgaagccgaggaacagcccccagctgtgacaacccaaaatgcctccagacctggccccatgtcctccagggggacggaacagcctggtgtagggcagggtcccctgagcaggagtggcacctgttcctgctcataccacagacagctgagctggctgtgcccaagactccctgcacccaccaaagccactggatacaggcacgatttgcatcttactctcttaagtcaggtttctggagatggctgtcccaacactggaatccagcctgtctacagcaagggagaaagaggaagctgatgttgggctgagaggggcaggcgttacagggtaggtctcacaaatgccgacgtgacaggcagggcttctgagggggcttcagggaccagcagggaggcgagactcaggcactgacccgcagagagcatggccttggacgcacagtggtgacagcagcctccaagtgtcccccgtgccctcaggcatgagggacagaagcttctggggcccctgcctctttcctgcccatcccctggtgaaggaaaatcgcctctgataggaaaagctggggccagactccctctccctgcattagtgtcgccgtcctgcctgtgaggtccccgggcccagggcacctcccgggacacccgagtggtgatgcacgaccctcagtcctggggcttaggacctctgggtgcccccgcaggtccgtcctggagtcacttcacagtcactgcaaatgggcaccacagcccactttccaacgccccaactttccacacccaagcagctccttgtccctgccaatcaatgcccggtgatgacaactgttcttttataaacaccacacatcttctaatgctttcatgttaaaagcggga

SEQ ID NO: 101 - DNA, 3343 bp, Homo sapiens
  cDNA CD274-201
ggcgcaacgctgagcagctggcgcgtcccgcgcggccccagttctgcgcagcttcccgaggctccgcaccagccgcgcttctgtccgcctgcagggcattccagaaagatgaggatatttgctgtctttatattcatgacctactggcatttgctgaacgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagtt

SEQ ID NO: 102 - DNA, 704 bp, Homo sapiens
  cDNA CD274-004
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggagattagatcctgaggaaaaccatacagctgaattggtcatcccagaactacctctggcacatcctccaaatgaaaggactcacttgggagaatgatggatgtgaaaaaatgtggcatccaagatacaaactcaaagaagcaaagtgatacacatttggaggagacgtaatcca

SEQ ID NO: 103 - DNA, 601 bp, Homo sapiens
  cDNACD274-002
atctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaaggtagtatttccttaattgcagtggtctccactgggggtgaggaaggggtgagaattggatcatggctgcaaggaaacccgacttaacctctgcaaggtggtgcaaaggcattccactgttcaacagcaattatattgaagctgagtgggatcactgggtgaagatgaagcgtaaggggtgaggggcaggagaatgggtatggatggaggtagaagatgcagtgtcatacagtttttttctatcatgaaaataaccacagacttacagaagagaaagagctaaaatgcccgtcattttcagttgcat

SEQ ID NO: 104 - DNA, 442 bp, Homo sapiens
  cDNA CD274-003
ggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataaca

SEQ ID NO: 105 - DNA, 2365 bp, Homo sapiens
  cDNA PDCD1LG2-001
ttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatccccttctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaa

SEQ ID NO: 106 - DNA, 2645 bp, Homo sapiens
  cDNA ICOS-001
cgagagcctgaattcactgtcagctttgaacactgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 107 - DNA, 2528 bp, Homo sapiens
  cDNA ICOS-002
ctgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 108 - DNA, 7080 bp, Homo sapiens
  cDNA ICOSLG-001
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtgcctgtatccagtggctttggtgggtgcagggagtcttgggcacagccagctcagctgtctgtggtatgagcaggaacaggtgccactcctgctcaggggaccctgccctacaccaggctgttccgtccccctggaggacatggggccaggtctggaggcattttgggttgtcacagctgggggctgttcctcggcttcagcgggtggaagcctcagatgctgttcaacatcttctggacacgggaggccccgacagagagaagcgtccacccgcaagtccacagtctgaggtctcccctcagagaccctgccctgcacacccacctccagccaaaggtcctgcctgccccagggctcaggggaaccttgccggtctgtggaacaggagaggggactctcgccagctgcaccaccctgcacgtagtaggtgtgcggtaaacatccaccagggaggctccagtcaaggctggcagatggggcggtccatccctagggcaggtgacagaagggaaaaggctgcctgctggcccccgagccaggtagcacatgcttgtgcctcagtttcccctcctgtaaagtgaggcgctggatccaggttctgtctactgggctctgcagcttggacgctcctaagaccaagcgacccaccctggggagggcagctatggctttggaatagctgtccaggcccgggtgcctccaagacggccaccacaccctgcctgtgctgcaggggtgcaggggtaaggggcaagactccagaggcctcctctctgcatctccttgtcttcagtggccggaggtgaggcctgagctcaggggaggggcttctgccacgaaccctatggcggggcacagcacacttttcccagggaggacccctgggccccctgcattatccccagcggagtgtggggtcaccttccaagagcgacattgagaagctccagctctaggagtgtgcagactcttaaccaggcaggcccaggccctggggcacacaaaggcggggcctgctctccccagctgcccctgccaatgggggctggactgtcctaccctcctcccttctacctccccactgtcttccctctccactgtcaccactgcctccctcttccactgtcctccatgcactgccctccctccaccttcccccacccccaccactccccatgctgtccccaggctccccccgctctcccccctccccactgtccccctccccatgctgtacccagctcaccccgctctcccctctccccactgtcccccctcccactccccatgctgtccccagctcaccctacatggacttggcgatgtccttccatggctcaccggtctgaatttccatgatgagccgggcctgcagctttgctcccctatccctgcccaggctgcagctgtccatgcagggagcgagctccagcacctgcggagtccttccgtgggggcctctccgtgccacagcagccagggacctcaggtgcctgtgcatgacaccaccgcccatcctcatcctgagccagcctctcaggatcaggacttggtttggcggcgttaaccttagagcctgcaaggggcttcctcctggtgggtctggccgtagcctggggaggccacagctccaggccactccagacctcccttcctctgggccttccatgtggtggcaaccaccgcagctgtaagggagggaaaatggagcgtttgttctcgggctgggctggggtctgggggaagccatgggcgtgaagactggagtattatttgatggagaagcggccactcctggagaccggcggcaaacacagaagcacagcgtggaaggtgctggtgtcagcccacacgggtgatggggtcagactcaggagtcacactcaggagtcaccaggctcaaagggcccaggcaccgcaagtcctgctcagccccagacacaatgcattcctgttgccctcgccctcagccaggccccacgcaggccagggagcactggcaaagcttggcaaccctctgggggccagccttcatccaggccgaaggtggtcagtggcccaccatggcccaggtagaaaactcacggattaagatttcatgcccgactccaaaggcaagagactttattattttattttttttgagccagagtatcgctctgtcacctaggctggagtgcaatctctgctcattgcaacatctgcctcccgaactcaagcaattctgcctcagcctcccaagtagctgggattacaggtgtgcgccaccatgcccaggtaattgtatttttagtagagacagggtttcaccatgttggtcaggctggtttcaaactcctgacctcaaatgatctgcccacctcgacctcccaaagtgctgggattacaggtgcgagccaccgcacctggctaccagacacttcagagttacaggttagtttttctttttcttttatttttttttttttggcggaggtgcagggggagttaaacaaacaaacaaaataaacaggccgggtgcggtggctcatgcctgtaatcccagcactttaggaggcctaggtgggtggatcacgagatcaggggttcaagaccagcctggccgagatggtaaaaccccgtctccactaaaaatacaaaaattggccaggcacggtggctcacacctgtaatcccagtactttgggaggctgaggtgggcagatcacctgaggtcaggagttcaagaccaacctgaccaacatggagaaaccccatctctactaaaaatacaaaattagccaggtgtggtggtgcatgcctgtaattccagctactcgggaggctgaggcaggagaattgcttgaacccaggaggcagaggttgcagtgggccaagatggcgccattgcactccagcctgggaacaagagcgaaactctgactaaaaaagaaagaaagaaagaaaaaaattagttgggcacggtggcaggcgcctgtaatcccaggtactcaggaggctgaggcaggagaattgcttgaacccgggaggcagaggtcgcagtgagccgagattgcaccactgccctccagcctgggtgacagagcaagactccgtctcaaaaaaaaaaaaaaaaaaaattggatacattgtaatacctcaaatacttgtaagtgaagcaccccagttcccatagagctgccgcactcagaggcttctgtaacctgcctgctcccagcattctatttagggtctggtatgtccagaatttgcagacacagcaattcctgcagcagcagtgcaccatgtggaaggggccccatgaccagcccactgtgagctcacacgtgatgactgaggcttcttcacacagcagggctctgggtgtgatacccagggcacacgcgtttgcacaggcacaggccacacaagttctcacatgctcagccccataagccgtgctggacaggcatggccatttacacccaggatcctgctgagaacagcaaccaactcaccaccctcgcatcatgatccttgccacacaggggctctggtggctttggtggcctgggctgtggctctgctgccagccaccttgagtgaagatccgggttctctgggtgctactcagctgctatgtggggagctggcccctggggtgatgagggcccttcccaacccgccctcagcccttggacagccaggatcacccggggctgtctgcatacagacttctcaggggagttctcagcttggacccttatctccccagaatcctggaacctgctccttctgctctcgtgactgactgtgttctctatgcaacttccaataaaacctcttcatttgaaaggaaaaaa

SEQ ID NO: 109 - DNA, 2907 bp, Homo sapiens
  cDNA ICOSLG-002
agagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 110 - DNA, 1009 bp, Homo sapiens
  cDNA ICOSLG-003
ggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactgaatcctggaacctgctccttctgctctcgtgactgactgtgttctctatgcaacttccaataaaacctcttcatttgaaaggaaaaaa

SEQ ID NO: 111 - DNA, 4246 bp, Homo sapiens
  cDNA ICOSLG-004
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggtgagtttgccgtgggaagcagcaggttctggggggcccaggggaggcttggctgccagctgtctttcagagtttcaaaaaactttcaaaaggcaaaagtcccttgccttgaacaactgttgttcctggagacgcagcgaagccctcgatggtgcgcatggcatttcctgcagcctccccttggcatgggatggcatcctggtgtgcactttgtcacactgcgatgggattttcccaacatgcacagaagcagagagacgagtgctagacccccgcgctccccagtgcccagccccgaccagggtgtccagggcgggtccaggcaccggcgcccagcccccatggggtgtccggagtgggtccaggcaccggcgcccagcccccgtggggtgtccagggcgggtccaggcaccggcgcccagcccctgtggggtgtccggagtgggtccgggcaccgccagcttctctctgtggcagccactcctgcagctctcgtttgcccctcagttccaggagcaacatagatgtggattcctgtccaatttgggaaaaatgtccacacacggtcacccacctggcaggtgcctctggctgcaaggggcgctgggcttcgcaggcaggccagccgggctccccgccatgggccaggatcccctccgagccctgtttgccgcccaggagaaggggttccccggggacagtgggctcagggtgtgcgcagccaccatgctgtggtgtcacctgtggacccaggcgagctgatggccgaccgcagaaacgcacttccaaggccaggtcggcccatccagatgatgcaggaacacagcttgctaaaaacacggccggcctgttcccgtcggagccagtcgaagttccctgaacaggccgctgtttccgaagctttaaaccctgtgtttccaccaagctgagtcctgagaaaaccgacgtctgcctgcagaagggaaaggggtgcttcatgttcctctctctccttcatctcccttccaaggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 112 - DNA, 50 bp, Homo sapiens
  Sequence of Binding Site of Probe cg18561976 of the Infinium HumanMethylation450 BeadChip
cgcgaggactgttaactgtttctggcaaacatgaagtcaggcctctggta

SEQ ID NO: 113 - DNA, 50 bp, Homo sapiens
  Sequence of Binding Site of Probe cg15344028 of the Infinium HumanMethylation450 BeadChip
cgaggactgttaactgtttctggcaaacatgaagtcaggcctctggtatt

SEQ ID NO: 114 - DNA, 50 bp, Homo sapiens
  Sequence of Binding Site of Probe cg16820186 of the Infinium HumanMethylation450 BeadChip
cgccccgggccacttggatcccggtctcaatttactaagcgaacccagag

SEQ ID NO: 115 - DNA, 50 bp, Homo sapiens
  Sequence of Binding Site of Probe cg04110283 of the Infinium HumanMethylation450 BeadChip
cgggccacttggatcccggtctcaatttactaagcgaacccagaggatgc

SEQ ID NO: 116 - DNA, 50 bp, Homo sapiens
  Sequence of Binding Site of Probe cg15313320 of the Infinium HumanMethylation450 BeadChip
aggtttacattgaaggcctgccctgtgcagggtcgacacctgtgagagcg

SEQ ID NO: 117 - DNA, 50 bp, Homo sapiens
  Sequence of Binding Site of Probe cg06142946 of the Infinium HumanMethylation450 BeadChip
cggtctcaatttactaagcgaacccagaggatgccccgagtcctggaccg

SEQ ID NO: 118 - DNA, 50 bp, Homo sapiens
  Sequence of Binding Site of Probe cg09169673 of the Infinium HumanMethylation450 BeadChip
ccacttggatcccggtctcaatttactaagcgaacccagaggatgccccg

SEQ ID NO: 119 - DNA, 50 bp, Homo sapiens
  Sequence of Binding Site of Probe cg24688248 of the Infinium HumanMethylation450 BeadChip
aagaacccaagactggggttggacagcaggattccagccctgttctgccg

SEQ ID NO: 120 - DNA, 50 bp, Homo sapiens
  Sequence of Binding Site of Probe cg14910296 of the Infinium HumanMethylation450 BeadChip
tcaaataggttaagtcatttaaacttggtcatgtgttcagcaaggcatcg

SEQ ID NO: 121 - DNA, 50 bp, Homo sapiens
  Sequence of Binding Site of Probe cg12524179 of the Infinium HumanMethylation450 BeadChip
cggttggctcaggcgcccacgacactgtatttatagagagctccttgcag

SEQ ID NO: 122 - DNA, 50 bp, Homo sapiens
  Sequence of Binding Site of Probe cg00915092 of the Infinium HumanMethylation450 BeadChip
agagatttacctttgcccagagatgcctgggaagctatgatgtttccccg

SEQ ID NO: 123 - DNA, 50 bp, Homo sapiens
  Sequence of Binding Site of Probe cg14703454 of the Infinium HumanMethylation450 BeadChip
cgtcttttacaaactagctcggtgtcatgagcactgtggtgaggcacaga

SEQ ID NO: 124 - DNA, 50 bp, Homo sapiens
  Sequence of Binding Site of Probe cg11326415 of the Infinium HumanMethylation450 BeadChip
cgtgaaacctagtgacatacgtcctgggtagagctggccagaggctccta

SEQ ID NO: 125 - DNA, 50 bp, Homo sapiens
  Sequence of Binding Site of Probe cg22926869 of the Infinium HumanMethylation450 BeadChip
tctctcaacattttcccctgctaattgcattttgattggttcaaattccg

SEQ ID NO: 126 - DNA, 50 bp, Homo sapiens
  Sequence of Binding Site of Probe cg12978275 of the Infinium HumanMethylation450 BeadChip
cagccacgctggacagtgaattctggtcaccctagccacagttgagtgcg

SEQ ID NO: 127 - DNA, 50 bp, Homo sapiens
  Sequence of Binding Site of Probe cg13458803 of the Infinium HumanMethylation450 BeadChip
cgaatggaaattctgtgaggggaccagttccaagaaccaaccacagccct

SEQ ID NO: 128 - DNA, 50 bp, Homo sapiens
  Sequence of Binding Site of Probe cg12323361 of the Infinium HumanMethylation450 BeadChip
ctcttctcctatacagtgctgtttccgaactgtacattggcttacactcg

SEQ ID NO: 129 - DNA, 50 bp, Homo sapiens
  Sequence of Binding Site of Probe cg06327732 of the Infinium HumanMethylation450 BeadChip
cgcttttgtgtggatgagcctccccaaccctgtcaacaacaaactgtcac

SEQ ID NO: 130 - DNA, 50 bp, Homo sapiens
  Sequence of Binding Site of Probe cg00697440 of the Infinium HumanMethylation450 BeadChip
tgttcaataactggcccagggtccagtggtcaagccaggactggacttcg

SEQ ID NO: 131 - DNA, 50 bp, Homo sapiens
  Sequence of Binding Site of Probe cg13069531 of the Infinium HumanMethylation450 BeadChip
cgtcagtcctggcattatttctctctctacaaggagccttaggaggtacg

SEQ ID NO: 132 - DNA, 50 bp, Homo sapiens
  Sequence of Binding Site of Probe cg09838701 of the Infinium HumanMethylation450 BeadChip
gaccaagacacagatcacccggggcttacttagcctacagatgtcctacg

SEQ ID NO: 133 - DNA, 50 bp, Homo sapiens
  Sequence of Binding Site of Probe cg03048921 of the Infinium HumanMethylation450 BeadChip
gtgaaggcagagccaggagcctgcctgcctctgttctccatgggaattcg

SEQ ID NO: 134 - DNA, 50 bp, Homo sapiens
  Sequence of Binding Site of Probe cg06033443 of the Infinium HumanMethylation450 BeadChip
cgccagtgaggctggtctagccttcctggggacagatgccaagaagttgt

SEQ ID NO: 135 - DNA, 50 bp, Homo sapiens
  Sequence of Binding Site of Probe cg04256691 of the Infinium HumanMethylation450 BeadChip
gacctcggagaggagcaacctcggggcgcgggagatcggctctaactgcg

SEQ ID NO: 136 - DNA, 50 bp, Homo sapiens
  Sequence of Binding Site of Probe cg06173626 of the Infinium HumanMethylation450 BeadChip
ggagaacttgggccgcgggagacctcggagaggagcaacctcggggcgcg

SEQ ID NO: 137 - DNA, 50 bp, Homo sapiens
  Sequence of Binding Site of Probe cg15588997 of the Infinium HumanMethylation450 BeadChip
cgggccccaaggttcaggcaggagagagcgtgaccttgtcctgtagctcc

SEQ ID NO: 138 - DNA, 50 bp, Homo sapiens
  Sequence of Binding Site of Probe cg08129658 of the Infinium HumanMethylation450 BeadChip
cggttgatcactcacctcggcttccaaagtgctggggaaattgattttct

SEQ ID NO: 139 - DNA, 50 bp, Homo sapiens
  Sequence of Binding Site of Probe cg02469067 of the Infinium HumanMethylation450 BeadChip
ttaaaccacatggcagcctttgtcaactataaagggactgtgtgtacacg

SEQ ID NO: 140 - DNA, 50 bp, Homo sapiens
  Sequence of Binding Site of Probe cg19689800 of the Infinium HumanMethylation450 BeadChip
tgtaccagcagctggaatctgaaggcgtgagtcttcatcttagggcatcg

SEQ ID NO: 141 - DNA, 50 bp, Homo sapiens
  Sequence of Binding Site of Probe cg06494497 of the Infinium HumanMethylation450 BeadChip
cgctgaatcctccagcacggatcctggaatagagaaagtgctctggtcat

SEQ ID NO: 142 - DNA, 50 bp, Homo sapiens
  Sequence of Binding Site of Probe cg05720980 of the Infinium HumanMethylation450 BeadChip
cgtgtaggctgtgtcaggaattataagtaatcaagggatgatttcatgta

SEQ ID NO: 143 - DNA, 50 bp, Homo sapiens
  Sequence of Binding Site of Probe cg08326410 of the Infinium HumanMethylation450 BeadChip
cgcatgatgtgaagtgacaagtctagtctgcagttttcagaaaccctcat

SEQ ID NO: 144 - DNA, 50 bp, Homo sapiens
  Sequence of Binding Site of Probe cg14238625 of the Infinium HumanMethylation450 BeadChip
caacagataccagcgtgtgtatagaacttccaaatgctgagcccagagcg

SEQ ID NO: 145 - DNA, 50 bp, Homo sapiens
  Sequence of Binding Site of Probe cg07233127 of the Infinium HumanMethylation450 BeadChip
gtctgcagattgtgctatctgagtggagatcctgaaaccaatcacccacg

SEQ ID NO: 146 - DNA, 50 bp, Homo sapiens
  Sequence of Binding Site of Probe cg20977982 of the Infinium HumanMethylation450 BeadChip
agcccctcacaacatcctgtgtgctgctgaactgagctggggcgcagccg

SEQ ID NO: 147 - DNA, 50 bp, Homo sapiens
  Sequence of Binding Site of Probe cg23404467 of the Infinium HumanMethylation450 BeadChip
tgcatgagcccctcacaacatcctgtgtgctgctgaactgagctggggcg

SEQ ID NO: 148 - DNA, 50 bp, Homo sapiens
  Sequence of Binding Site of Probe cg26736736 of the Infinium HumanMethylation450 BeadChip
caaaaccgggttgccagctcccatgtaccagcagctggactctgaaggcg

SEQ ID NO: 149 - DNA, 50 bp, Homo sapiens
  Sequence of Binding Site of Probe cg24006991 of the Infinium HumanMethylation450 BeadChip
cgaagtttcaaaaagcaaaaaactatgttgaatcgacacaaattgagtgg

SEQ ID NO: 150 - DNA, 50 bp, Homo sapiens
  Sequence of Binding Site of Probe cg12832565 of the Infinium HumanMethylation450 BeadChip
cgaatataataacagctatgaaagtgtgagcaatgacgaaactggagaga

SEQ ID NO: 151 - DNA, 50 bp, Homo sapiens
  Sequence of Binding Site of Probe cg10798745 of the Infinium HumanMethylation450 BeadChip
cgaaactggagagatagggttttaacaagatgcaaggacaatctgaggac

SEQ ID NO: 152 - DNA, 50 bp, Homo sapiens
  Sequence of Binding Site of Probe cg15892497 of the Infinium HumanMethylation450 BeadChip
cggaagatctatgacttctaacaacccattctgtggttttcaaagagcga

SEQ ID NO: 153 - DNA, 50 bp, Homo sapiens
  Sequence of Binding Site of Probe cg27224823 of the Infinium HumanMethylation450 BeadChip
tgttttgttttctttcacagatttaataccgcgatctcagccaaactccg

SEQ ID NO: 154 - DNA, 50 bp, Homo sapiens
  Sequence of Binding Site of Probe cg13331246 of the Infinium HumanMethylation450 BeadChip
gcgcagcagcggggcctggggcagggccagagagagccaattggggtacg

SEQ ID NO: 155 - DNA, 50 bp, Homo sapiens
  Sequence of Binding Site of Probe cg23588699 of the Infinium HumanMethylation450 BeadChip
ccaattggggtacgtgggccgcggtcgggaggcagagtcaggggcgttcg

SEQ ID NO: 156 - DNA, 50 bp, Homo sapiens
  Sequence of Binding Site of Probe cg10982045 of the Infinium HumanMethylation450 BeadChip
tagggcttctgcaagggccaccagagcgcctaggtggcaagtgggcgccg

SEQ ID NO: 157 - DNA, 50 bp, Homo sapiens
  Sequence of Binding Site of Probe cg00087884 of the Infinium HumanMethylation450 BeadChip
ctgggcagcctctgcaacaaaacagaccaatcttcttgtggaagtcaccg

SEQ ID NO: 158 - DNA, 50 bp, Homo sapiens
  Sequence of Binding Site of Probe cg10059687 of the Infinium HumanMethylation450 BeadChip
ttgggacagggctcaaagctgcccctagcctcctgcgtctcaactcaccg

SEQ ID NO: 159 - DNA, 50 bp, Homo sapiens
  Sequence of Binding Site of Probe cg11756870 of the Infinium HumanMethylation450 BeadChip
cgaggctcttgggacagggctcaaagctgcccctagcctcctgcgtctca

SEQ ID NO: 160 - DNA, 6175 bp, Homo sapiens
  Coding Sequence of the CTLA4 Gene
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaaggtgagtgagacttttggagcatgaagatggaggaggtgtttctcctacctgggtttcatttgtttcagcagtcaaaggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggttaagaaaccatgtagtttgtatgaagtaggtactcaaaagatatttgatgatttaatttttactggagaagaaatattcatatatgttttcttatttttacatgttttaaatatgtaaagattaaataaacactcttagaagtatttaaatttcctaaagtaaatttatctcaaccagtaacaggaccctcccaatactggaaagttgagtgtgaccgcatttagtggtgatgagtgtgagcttgcttggggagagggcaggacatttaggatttcttaagcttagagtcaatacaataaagattattgagtgctcacttgggtgggctataatcactgctcacaggagttcatgaaccacaagtaaaagagtgaggagatatgattagctcacaaataactttaatacagagcagaaagtaatgaactactgcaatggagttatcacagtgctaaggatgctcagagggcatctctgataggcagaggtgagggttagggaaggaagctgtagtctagctagctagagctgctggaatagacatgacaatggctgctgccaaactgttttctcttctgaggacagatgtcccgtgcaagtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagcctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctgttatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattacaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 161 - DNA, 5944 bp, Homo sapiens
  Coding Sequence of the LAG3 Gene
gaaggcccagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccaggtaaaacggggatggcgggagggttgacctccagccccacaggaggggaccagcagggatctctgtggccacaaaggtcctgaggtccttagctctgtggattcttctaatcccttttttgggcagtccttccaccccgaaagcctctctgggcagagaagaaacagaaacccaagttcttcctgcaccctgtttctccctcgggaaacacccaggctccttctctacccctgcctctcggctcacgccccctccccttggcctctcttttgctcacctagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacaggtatgcaccccaaacttgggcaacaggacctccgaatccagcactcaaccccacacccgtgccggtcctctgtcccctgccctgaggtgtcactccctctgaagccagtgacccagtctccctgccctcgcttgcaccgttcctgcccttgctctgcaatcagcgaccctcacgccagcatcccttctctccagaagtggatgcggccagtccaacagaggggtcgggcgtgaggggacggttggtggtcaagagaactcttggggcgggctttctcatcctcaacgggtggctgcctgcatcctcccgggcttcctacccctggagcttctcaactccattctctttcccgcccagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgagtatgtggggcgggacgatgggagaagggctgggaggtgggtccccatcccctgcctcccgggacgcaggaagggctggggcagaggctgcgccctaggccctgtcggagagctcccagaagagtagaggaagggggtgggcggcctgctggagtggaaggtgcccccgaagcacgtgtatggggggccctgtggagagattgtgtcacccccgagctccccttctcccacccacgcgggagtgcccagagggagggggagggggggagagcatggggctaaagtgattcatttcagatatctgtagctcagggggtgggcttcgcggggttccaggccaggaaaacggcaagggtggctgatgccaagtaaactccaggccagggacggggaaagtggtcctggggagtcttggggatccactttatgcacctccaggtgctggaagctgagatggggagagggtgatgtgggagaggagaagacaagtctaaagccaggtgcctgtttccaggagcttccggcttggcagccctgctgtgttgggaaattgtttccagtgggctgatgaagtcttctttatccttgcacagtgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtaactcccccactctgcttcacatttgaccacaactccttcctgccccccttgtcacctcccctaactatgggtccccaaaccaggttctcggcagcgagtggcctacgtcattgctgtgggtctcactgttcgacccctttatattgctggcagcctcacagctgccatcaccccttcttgcttctcccgtggccttccagcgtcattgccggccttccctctccttccggctaagcccacttgctgggtttctgagcctcctcagctcatcaccttattctgctccttagcactcttatgagccagaccatctcctgaattcttctgcctcccttccttgcagccccagcactccctccccactgcagcacccagctttaactttgggttttcttttctcttcaggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacaggtcagcctcaggtgggaaaggagtagctgccctcccagggtagaaaggacagggaggaagggctggcagggcaaagactaggcaaacccaccctgtgatgccaggccactgggcacaagttccagagcctgcccatctcggcccccacttttctcacccccataataaagaaacgaaactgaaaatctcctcttgagtcacaagataaaagttccaccgttctctatgggactcccctgctctcaattggcgggagggtctgggaagttagaaggaaaggtgacaaaaattctgaatggttcgaaagaggtagaatatatttctagaatccttgtctactttgcagccagggcttgggttagagttgcaggaagtggcctggatttgggaggagtgaataaatccgtcccttggtcagcaaatatttactgagcaagggttttccaagacagtataaaacaaacacagaaaaaagaatactcagagagtatgtgttgactggttgataactatcggccatgacagattagccatgtctgcagcacgcacctgcggccactcagtagtagcaccccacggcaggtgcttaataatgtatagagattgaatgaatacgtgaacatgctaatggataatacatctcctgaaggccaatcctgagttttcacttgctttctggatacctctaactagatgttataccacctctcagccgccttaccctgaaccccagctttttctcccaccaatccccttgctgactcagcctgtcagtaatccactggtatccatccacctcgaaacctggcctcctcctctctacatcccatcagtcatcaaagtccaccagttctttctgtccaatgccctcttgaaggtcaactgttttatgtagacggctcaatgagagagatactgttaccccgaagactttctcaaaacagctgggaagtgccagactctgggtctaaactcaggtgtctgcatcaccaaatcactctccaggacactactcagatgcccttcaccctttgtctcctcccacccacccatctctcactttacaacttggagaatgctctgtctctagatgaatgggtcagttccctgttctctataccttcagaaagggggatgatgttcattcagggggcaccacaaggcaggggacactgatgtgagccgcatcatggaagttccaaaattgtgaagtagatgggggtcagctcatctgactgattttgagggttctgagcatttgagtagaaagtaatgtaaaagaatctgtaatagtatttattctgtggtctgccagggccagtttgagtgtgaaggcagtagggagcctggaaatgttttgagcaggggagggagctgactagagcattgtctgaataagataaatgtggccggcagggcatgatggctcacacctgtaatcccagcactttgaaaggctgagacgagaggagcacttgagtccaggaattccagactagcctgggcaacatggtgaaaacgcatctgtatacaatttaataaaaaaataaatagaaagaaaaagatgaacgtggccatgacccatgatgtccttccccaacctcccctggccagaacccaagtgagtgcagggtgattgagacttggggttcaacctgtgatatcacgtaaggggggcagaatcccaaaagatctcttccttctactcttttcagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtccgaggccccagaatgccaggacccaaacgccacagcaataatctttatcctccttccagaacagcccctgccacccccatcccagcgcttttctttccagtcagggacctgatctctggcttttgcctagggttgacccgtttccgccactgatcagctgaatgaccctgggacaagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcatccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctctcactccagggatggcttgtgcctgggtaggctggaaggggggttgggagaaagccaggaccagatggggagggcaggggcgctgagaaaaaatagagggactcagtgtccctcctcatccgcttcccttcatccttctcctccttccgccctccgtctctctctccatctcttctcacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaa

SEQ ID NO: 162 - DNA, 2753 bp, Homo sapiens
  1st Promoter of CTLA4
tcaattccagcattgatctcactctatcatgatcatgggtttagctgtctgtccctgccactgctgtgtgttcctcttgagggcaggaacatttgtttttcactttttaaaaaacctctgttgcccagtctggcattaggaagtgcccattaggttgttattgcttgttggcgcttgagctggggcttgaaggtttctataatgtgtagcagtgtatagaaaacaggcaggtcagaaaaggcttctgtgcatcacaccaacatggcacatgtatacatatgtaacaaatctgcatgttgtgcacatgtaccctaaaacttaaagtataataataataaaattttaaaaaaaaaaagaagaggcttcctggaggagatgacagctgagctaagtcctggaggatgagaaggagtataaaataagataataggagaaaaaaggcagtaggaacagcatgggtaaaggtgatgaggcctgaaagaggcacgtggaaggaaagacaaatgcaggaagggggaatgggagggaatgctggggtacaggccaaagagggaggcatttggtgagtattctgcagagtctcctctgctgtgctgaggtgtggacaatgggaaaccatggacggactggagtaggcaaatgtcatattccctgttacaactgtctgtttgcatgtcagccttctagaagccccttaaggtatcaactatgtttttgttttgtcatcattcaatcctaagtgcacagaattccgggcatattacaggttccccatgaatgtttctttctttattaaaatgtatgaaaactctccagatttaaggaaggtcctcaatgtttcaaattctttttgttagatcattggtcctgtctacagctgtcacaaatttaaggactctggttatatttaatcttcacttttgaattttctgcttgaaaaatttgtattagaaaaaaaagtctatccttttatggacggctctaatctcttgaatcatttgggttggcttttctttggaccttcttcaactctgttttgtctctgttgagttaaggcttttaagaacacctgaattctttccttctgcaaaaccagaggcagcttcttttccgcctattttcagtttatttcttgtgattttagtttttttctcttaaccaaatgctaaatggatttaggagaaataaacttatttgtaaagctgtcaagggaccattagaaggatggtgcttcacagatagaatacagtttttattaatgatgcctagacaaatcctgccattagcccaagggctcagaaagttagcagcctagtagttttggagttgtcaatgaaatgaattggactggatggttaaggatgcccagaagattgaataaaattgggatttaggaggacccttgtactccaggaaattctccaagtctccacttagttatccagatcctcaaagtgaacatgaagcttcagtttcaaattgaatacattttccatccatggattggcttgttttgttcagttgagtgcttgaggttgtcttttcgacgtaacagctaaacccacggcttcctttctcgtaaaaccaaaacaaaaaggctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaaggtgagtgagacttttggagcatgaagatggaggaggtgtttctcctacctgggtttcatttgtttcagcagtcaaaggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggttaagaaaccatgtagtttgtatgaagtaggtactcaaaagatatttgatgatttaattttt

SEQ ID NO: 163 - DNA, 9627 bp, Homo sapiens
  1st Promoter of CD80
acactgttcctgacttttccccctgtttagaccctgctcatatactctgtaccatctgatccttactttttctctttctaaacagtatttatatccttaaaatgcacagggacttgaacagctgttgtcagggtgatgatggcaacaatcactgctcatgggacccctgggccagcagcatagcggtgtgtgttgcagggagaggaggatgtgttctgtgaatggtggcactttggggtattctcttttctcctagctctgagttctcagactataaacttataggcaatgcttttcctacatctcttgcctcctcctacaggaggcctttcccctctccttagacctgaccctctcttaaaggactccagctctgaaggaaaagctgcccacattggtccctctgagggctgccctgttagagcctctgccttactgccaccagttgctggactataaagtcaggcgtttctgcctccatagacagtgcctgcaggcctagagggggagaggagcctggctggttccaccctgtgcatgaaagaggagtcccttcccctgggcatcagtggctgggcaggaggagagggggaacacctctgccatggtgtggcaggagaggaaggcctagtgtggcaaatctctgccctgaataaagccctctataatcctactccactgtattcactgaatctcacctcccacagaccatgcacactcacacctacactcccgttgagcagtcctcactaattttacatggtacacactctccaacccatcaacttccttctgatccaattcttttcattaaagacatcatcagttactgtaagttactgaaataacctcctaataggttttgcacagtcactgtggctgccctacaagccactctgttcttcagtaacacttttttccttttaaagttatttacacctttactactgaaactcaaagtgtatggtggagcagcatcagcatcacctaggtgcttcttagaaatgcagaatctcaggccccatcccagacccacctaagcagaaacagcatttaaaaaactatatagactttattttttagagctgctttaggttcatcgaaaaattgaatgtaaagtaaccccctccccacatattcacagcttccgccactgtctacatcctgcgccagggcagtacacttgttacaatcaatgaacctacattaacacatcattaccaccccaaatctagagttcacgataggggtcactcctggtattgcatattctatggatttgggcaaatttataatgacttatatctatcattacagtattatgcaaaatagattcacttctctaaaaaattccctgtgctagaaactgcaatttagcaaaacccccaggctattggtatgtgtaaagagtgaacagagctggggtagaccacgccactctcctgggtaaagcccttccagcttcctgaataacatgcggattcatgattataactcacaagtgctgcagggtccggttcttgctcactgggccagtccctcctctgctacttcccagctcactgccccttcttgctggcagaggaagacagcacttcctcaggcagtgcctgtgccctgccttcaaagcacgtggctttgtttgttggccacactttaacacattcatttgagtggctattggattacttttcctctttccaatgatagtaaatttcacaaatgcaagagccatgtccccaggaccaagaaaagtctcttggttttaggagatgctcatgtttgttgaattaataaatgattaaacaaaagaatgaacacctgtgccagcctcatccttacctttgtgcctttgtccaggctgttgccctgaccagaattctctctccatcatccatctgcctctgtaaagcctgccctccttcctgcagcccagtctgttacccactttcccagatcttgggctcctacaatcagggcaaagcatttcattgctctttgcttgttctacatgggttagctttgcatttccgcaactaacatatgcagacctctttgagtgcaggaatcctagcctcaacttttatggcccacctggcacacagtaggtgcttcattgactcagtcacagcagcagtaaaaccaggatgtagctagagaacaaggtgctttcctaaacatctttctttagctcaaagatctctttccacttacctctgaccctaattttccttgtacaatttctaaagtctgggttttaatttttattttatgtcctcttttactttttttattgttctccctctttctgtctctccccctccctgccccccttatttctgggaagcctgtacaaatttccttctatatattttaaactcctctgtactccccagaagactagtttgggaatgcttccccagctccccagaaggaaattgtaactgttggaaatgtaatgtaactgtcaaatatataaaaaacctgaggtgtaaattgtgaaatgtaggccatgtttctcttggttctgaaacaatgtaaaatagctctggacagaaaattttaaatgaccaccatcgcagtcaagtaatctgtgggcccccaactcctcttctcttccctctacctctctctcacacctctgatattctaggcagtactttatgtgagaagtttttaagacaaggacccttaatagtcgggtctttgcagactggcaaatcatgctggagcccaaacttctttgtttttgggaaactgggaagtatgctgctcactagaaaacagatcttttgttttctgacttaaaaaaaaaaatcagaaccatcctgccagcagggacaagcctcacccttcttgacagtcccaaaagttcagcactcttaagatcacctgagcaggaacaaaagcctctagaagtcaaattattactttcaggacatatatgtaatacctatgtggcagattaaaaataactaaaaacataattttgtgttaaatctgataccacttaaagtcagatgccaatgttgaaaaaagatctcagcatccaaagcagaacaaataagattaatgtattaagaggaacttaagaaggttaagaagatgaatgtcattaagaggaattgtcctcaactactctcccgccttcagattggaaagaagatcaccattgttcaattttagaagcaggacactttcgctgagctgtatcatgaaaacatagtttgggactagactccgaggccagtatcggcacatcacaaaatgtaaatgagcatctaatattcatggaagagaccattatgaatcggctgtatggttttgttaaaataacactgtcccttccacgcttccttgaaggcctgggttcttgagttaacttggttgctaacttgctgtgtgatgataggcaggtcctttaacctctttggaccacagtcttctaatctttaaaatcttctgaaaacaccctgaaggttccttccagcttataggataatagaagggagcagctcagagaaccccatgtcctttctcttaaccctgtagcagttgactcagttaagttcctgaaagttgcttacctgaacagaagtgagaaagaccagccagcaccaagagctgaaagaaattgaggtatggacacttggatggtgatgttccctgcctccgtgtgtggcccatggcttcagatgcttagggtcaaaagtgaaagccaacaatttggacccaagtaagaccagggcacttcccaggtgcaaaacaggcagggctgatgacaatccaattgctcacgtagaagaccctccagtgatgtttacaaaacacacagagattggagggtgttcctgggtctccaaaggttgtggatttagtttcacagcctgaaaaaggaacaaataaaagtcattcaggaaggaaggtgtgcctactttgagttgcaaaactctcgagttgcctgctaaaattaattggagagcttaacctaagcaacctctaaagcagggcgtgaccctgaggaaaagcgaatggaaattctgtgaggggaccagttccaagaaccaaccacagcccttccatgaaaaggctttctacttaataggtggggtgaagatttggttagaaacaggagagctctaaggaccctccatatctgttagccaacctgcaaaagttcaaatcctcttctgaacataccaagaaacatagagcagacagtaagggtgtattttgtccaaggcaggacctaagttatgaaacaacttctttcttgacatattaacataagaaaacaagtatctcaattctttaaaccctctactcaaataatatatcataaaggggtatgagatctcaataaccagaaaagtctatccataaaaagggagggaaaaaaagacactgcagacgttacttatcaaaattatgtactccagggccaggcgtggtggctcacgcctgtaatcccagcactttgggaggctgaggtgggcggattacttgaggccaggagttccagaccagcctggccaacatggcaaaaccccatttctaccaaaaatacaaaaattagccaggtgtggtggtgggtgcctgtaatcccagccacttgggaggctgaggcacgagaattgcttgaatccaggaggtggaggctgcagtgagccaagatgattgcaacactgcactccagcctaggcgacagagtgagactccatctcaaaaaaaaaaaaaaaaaaaattatgtactgtcatgtgaggtggctagggattaatttttccagtaaatatgtcaaaattgagaaatgaaaataaacactgtgctccactgtcaccccttcaggctgctaccaggacacagccccgtgctgctcagagaatgcttgagtgtcctctttggagaccaccctagagctagagttccagccacgccatattgttttattagccatcatccattttagacaggattagttaaaagagacttattcaccagaatttgtttttcttaagatagaatcttgctctgtcacacaggctagagtgcagtggcgtgaccatagctcaccacagtctcaacctcccgagctcaagcgattttcccactttcactagaattttactggcttgagaaattcaaatacggcccacaaaaacaatatttgctaggatctaggatattttaaaataatgggccacaattctcactatgatgctccaaatatgtcgggaagccacagcctcctgtgggaatgagaccctaagggttcctttgagggcaagcctggatccaggaggtggtagcagaggtattgtttgtttaaaaagcagtgaggttgctggtaactagttctaccaagctatcccatagtaagataatagtaaatgtacttacttgctgaagaaaaattccactttttctttaaatcctttgatttcagggtaagactccacttctgagatgttctcttcttacagtctataaagcaatgacaaatcactttttctttgggtaatcttcagagaggcgacatttccccttctaacttctgttactttacagagggtttgagttcactcagtacttgtcagtgccaggagttggacagggtgtttgaagaagcgccctctgctgccgtcttcttctagttgcttttgtagaggctgtggctggggcaaatcacacagcagcctccctcaccaccgtgcatggactaacaaacatgaaacaccacgagcaccaggcggcctaggggaggagaagaatggtgcccgagaagagtgaggggcatctggctagccttgctgtgtgatgggaggccagcttcatgggctggctgtttctgtgctggtctcaagttttgttttagcacccagagttactcctgagtccctgcaggaataagctgtcaacctcatatgtaggggacacttttgggagagtgctcagctcacaggaccacccaactctactcccacctctgaatcccaccatcttcagagagtgggctcctgccagccacgctggacagtgaattctggtcaccctagccacagttgagtgcgcctctggtgggatgaggaagactttagtcatgcccatcactcccatttccaactaggttgccacccacccctgtgtgtccctttgtaggattctggagcccctgtgagtgagcagctgacccatgctggaccagtgtacttgtttgcacaggtggaacctgacagcaccttgcatgggttgcagtgagccgagatcacaacactacaatccagcttgggtaacagagcaagactccatctcaaaaaaaaaaaaaaaaaaaagacgccatccttcccacaccagccagaaagagagcaaaccgtgtgggtgagaaatactgactacagcggcggcttccttcatctcagcaacaagtttgtggcagagcttagtggataccaccctattcacctgagatttggaatactgaagctttggaaatcatgaaggcagaacttgctatgaaaggactccactgcactgtctccttctgtattggcagaaggggcctagtgagcacccttcttcacctgtgtcttgttctggtctcagatgcatattttgaatagttgcaaggaatatggatgtgacaattcctgccttacctctagtagatcaacattacattttcaagtaaagggaacatagattggaggtaagttcatgttttctattttcttgaacatttattcagatcaaagaaatgttttcactgattttagccacttctacttgatacattattacaatgcactggaagtgattttttttccaggtatttaaagtaatagaaagttatagatgtcaacttaaaagagcaaagaaatacagagttttagaaatttattttctttttttttttttagatgaagtctttctctgccgcccaggctggagtgcagtggtgcaatcttggctcactgcaacctccgcctcctgggttcaagcaattcttctgcctcagcctcctgagtagctgggactacaggcgtgtgccaccatgccaggctaatttttaaatttttagtagagatggggtttcaccatattggccaggctggtctcaaactcctgaccttgtgatccaccctcctcggcctcccaaagtgctgggattacaggcatgagccactgcacccagccgagttttagaaatttcatgagggactacatgaatacaaattttgacgatcacagacaccctcaaattttaagaatcccagtgaaatcctaacctgccttggagaaacacacattaaacaactttgccattagcgctttgatgtgacttaatcaaagaggctggaagaaaggaacaccaggaaggtactttacagagtttccccaatcctgattgtaaaattcagaaggcttctcttccaagattatgtactaatgggatgtgtttaattcctcttcctcctacaatgtgtctaggagcatgacctgtggaccacagatttctaaggtaaatttctggacactggaggtgagatggatgaagacgggcaaaggaagccgaacccgaatacctatattactggaaaacaaaacaaaacaaaacaaaaccaagtaaaagatttaaaaggaggctgggcacagtggctcatgcctgtaatcccagcactttgagaggctgaggtgggcggatcacttgaggccaggagttcgaggccagctggccaacgtgatgaaaccccagctctccaaaaaaaaaaaaaaaaccaaaaaactgggcatagtggtgcatacctgtaatcccagctactgggaaggctgagacatgagacttgcttgaacttcagaggcggaggttgcagtgagctaagattgtgccattgcactccagcctgggtgacagagcaagattctgtttcaaaaacaaaacaaaacaaaacaaaaaaactttaaatgagtttgttctgaggagcagacccagggttggagaagaataaagcaggaattactgctcctcagtgtaaattctttagtgccacttatttttttgtaaatccatccttggctttactgtaataaaagtaaaagaaattcttttaaaaataattcacataaaaattcttttaaaaatttttatgtgaaaaattgaaaggataaatttatgaaagtatatttttataattctagggtgagcaagacacaaaacttggaagccacgaaaaaagaaaagatacacagatttgaattcataaaaattaaaaatatttgtacaatgaaagacattataaatgaaatgaaaacacaatcacagactgtagaggacccagcaggaagagatgacgagagggagatgcagctttgtcactcagaggttggtgcagaggctgttgcgacaccgtaggggaagcctggccctttgctttacccctgaacaggatgatctctgtggaaatgaaggttccatctttctgctcttgaccttggagccacttcacctcctcatgctgataaagctggcctgagctcaaccttcctacccttccgttcagcatccacagggagggctgggctggctcctggcagtggcctcagtgctgtcatttgcaggttgcctactcagggcccacggtgctagcctgactgctgggaaaacccctttcccacagtgggctcactgttgccaagtaaacaaaacctgttgcactgacaaaaattttcaggggagtttttcatgttctaagatgaccctcccgtgaggtttagaagttcatttttagatatgacttcatctgggcatgtctataaggcctgcacccatcatagggcagctgatctaggctttaaggctatggtgctccccaggagtgccacagcctgctaaagttggcagcaaactcatcaaagtgggagagttcacctcttcctcttaaaatgctgtcacattctttctggttctttgagatggaaatcaccaaaatgcttaaaatgaaaacaagtgactttcagagctagccctcgttcagagtgagggccgtcttcttactaacccaccacacactcttcctcctatacttggcatcttactcttcctgcctgtgactctttttttttaattaatttttttattatcaatttttgtttattattctactttaagttctagggtacatgtgcacaatgtgcaggtttgttacatatgtatacacgctccatgttagtgtgttgcacccattaactcgtcatttacattaggtatatctcctaatgctatccctcccccctccccccagcccatgacaggcccccgtgtgtgatgctccccttcctgtgtccaagtgttctcattgttcaattcccacctatgagtgagaacatgtggtgtttggttttttgtccttgtgatagtttgctgagaatgatggtttccagcttcatccatgtccctacaaaggacatgaactcatccttttttctggctgcatagtattccatggtgtatatgtaccacattttcttaatccagtctatcattgatggacatttgggttggttccaagtctttgctattgtgaatagtgccacaataaacatacgtgtgcatgtgtctttagagcagcatg

SEQ ID NO: 164 - DNA, 4619 bp, Homo sapiens
  2nd Promoter of CTLA4
aagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagcctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctgttatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattacaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccggagttgtctttatcatccttgcatttgaatattgtgttcaaatttttgattgattcattcagtatctggtggagtctccaatattagaaatactggaaacaaactgaaaaaccacaaaaggacaaataatgc

SEQ ID NO: 165 - DNA, 1115 bp, Homo sapiens
  1st Enhancer of CTLA4
atcctctttccttttgatttcttcaccactatttgggatataacgtgggttaacacagacatagcagtcctttataaatcaattggcatgctgtttaacacaggttcttcacctcccctttcttaccgcctgctttctcagctcaactatcacaggcattacagttgtcatggcaaccccaatgttggcaaccacgtcccttgcagccattttgatctgccttcctgaaatatagagcttttccctgtggcttccaaatgaactattttgcaaatgtggggaaaacacacacctgtggtcctatgttgctatcagctggcacacctaggcctggcacactaagccctctgtgattcttgcttaaccaatgtatagtctcagcacatttggtttccacttaaggtttcctatttttgacctccacatcctgttattgtcttttgcagtgattctcagtgtggtcagggaccacctgtaactgaatccactgggtcacttactaaaaacaccaattcacacttattcccagatgcgttgaatcagaatctttgagtggtggggccaggagtttgtatttccaaaaatcttcccagtgcttcttatacccatcaagttttgagaatcactgcttaggcaactctgtctgtgtctcttcctctgtctctcccccttgctcattctcttgcttgctcttgctctctttctctctttcttgccccagcaagtgctaacaaacacacaagacagcacatagtaagcatttcaaaaggggttgttaaaaaaaaacgaataggtctttcaaagtaaggtaatgattattacctagaatgagctccttttctgtggaagactgtgcttcttgctctctaggcctttggatggtagccatgaagaaaaacaccaatcaggagcctcagtggatagtatatcatttccactcctctaaacatctttagagagattactctttttcatagttgatgggcagatctgagtgacagagagtgccttacacaagtgatgccctccaggtacctttcagacacccttagataatggactactttatataagcttaatatttcctctgctattgcctaaaattctaccatttg

SEQ ID NO: 166 - DNA, 1380 bp, Homo sapiens
  2nd Enhancer of CTLA4
cttgttttatttcatatatatatattttttctcatctcaggtcaattttttctgttcagtccagaaacatgacacaccctattggtaaaaagggaggaaaatttattctttcctcttttatgtttccttggctacatgctgggataggggctcatggtaagtttgccagattcaaccaaaaaacgccacaaaaacaagaaaacaggatgccctgtattttatctgacaacgctatcagcaggaaagcttatgcttctaatgcagtgtgaataaaaagtgtactagaggctgggtgcagtggctcacacctgtaatcccagcactttaagagctgaggtggacaaatcacttgaggtcaggagtttgagaccagcctggccaacatggtgaaaccctgtgtctactaaaaatatgaaaattagccgggtatggtggcaggtgcctgtagtcccagctattcgggaggctgaggcaggagaatcgcttgaaccgggaggcagaggttgcagtgagcaagatcacgccactgtactccagcctgggtgacagggcaaggctccatctcagaaaaaaaaaaaagaaaaagaaaaagaaaagaaaagtgtactagagacccctcttcagaagtttctgagcaagaacaacttgagactgtgaccactgttccaactgtaacacaatctcctgttctcacttccaggcacatgtgggattgatgctatgtcactggaagctaatgagacctgcagaagaggtagctatttctcttctaagcaattttcttagaggaagttaacccatcctgctgcatattgcaaggaacttgacattcagacccttcttggaaatctgctttcatgggcacactctatgttcttgcatttatttcgtacaataatcatctgaagcatttggaaaaagtgcagattgaagttcctctgaaccagaacttctcacttataaggtctgaggcagggcctggggattttaattcttcagagagcctttaggccatagttcataagctctgatctaactcaggattctaccatcatagatgattagcaaaggatattggaaatgatcctcagattttagaagaacataaggctcggagactttagggaccttgtccaaggtcctatggcgaggcaggacttgaactaggctaagaagtcagatctccaggttttcacatcagggctctgcagagggtggcactgtgcacctttctgaccaggggctgtcctttccaggctgcttctaggacgtccctgctaccactccaggccacccacagaaaacccacttttccatccatctccatcccaagtactcctgttacatctcggtgtgattatcaccactgttgctgctcca

SEQ ID NO: 167 - DNA, 2273 bp, Homo sapiens
  3rd Enhancer of CTLA4
aattccaaagaccatgttcttttcgaatgaccatatctgacttctgggggttactggcaaaaggaaaagagcaaaatggaaggtgaatggggattgaagtattggagaagtaatgcatgtattacaggggttacaaatgggtgttgatatatcagccaatgtttttttggacaaatattttaaaaagctttctgaaggtgcttattttgagattgtcaccagcagcagctctctcctgtaaccagagaggaaaacaggaagttgaagacattcaaagatggaccactggctccaatccacagttttagcagtaactagctgctttcccatttactggcgctgaagtcagcgctgcaatattgctggcttgcatgcctttctggccctaaggtatcataggttctctcacactgatgcttggctcagagatgggggaaaatggaaatcattaacacagccagtgagaagctctgatcttcatgacacctgcagcacgctccttgcgaagagggtgattctccatttgaaacaggctagagatacaggacataatgaacaatggaagtcagtgggagctaccttgcattcatatttgtgaactttggaatggggctagtttctaaaagggtaataaccagcctggagcagaagctgagggtggggcgtcgggggtgaagaggagggagggtctctgagttcaggctgagggatgctgggaaaaggcaatgactccctttgaggaaaaaaaatagagggcaaaagcagactccagggcctgaagatgcccccaaatggcaaattaagtgaactggtatacggtgaaaaaagttatagagctgggtccaatgccacaggccacatagaagattgagagaggctctaggcagaagcagggagctggtcagccgagattgtgatggaggtagctatgcataagtaatttctaccagaagttgaagtgtaggaatatctggggtcaaagcaaaaaaagactttccctgctgggaatggaagttaaaagtaatgattccactctgaatcgctgggggtggaggcaggtgtgtgtgtggtgtgtgtgtggtgtgtgtgtgggcaccaagcaggggtgaaagctgattatggaggggtggtgtcaggaaacatcacaaaggaacccctgagtgctttaggcctaggcggagctgcgtagcatggactgcacttgtgccaattcgagtgttgatagtgtttgtaatttgtgcctgagaagacatgattcaaggatggcatgaaagttgtgtgtaaggtgtgaagggctgtcacatgaaaaatagattagattttctttgtgggcttcctggagcactcagcgctggtgttccacagaagcacatgacgaaagagggggttggtattatttttcttcctgttttaggcttggattcagagtcagagagagggcattggaccctgtcgtactgcagactggccagaggcaggcctgttggatcctcactaacagcagctggtgggtaaaggaaggcatcagaggacctagttgggcaggggcctggggaagtagacctgcttgaatgactagctcctgctggcctagctcctcctacggcctgcctctgagacttgttacgggttcaggctccattcaggcaggcgtcactgtgcacagagatctaccttagcaggagggtgccacagcaggaaaggatgtggcaggaaatgcccaaagccagatagacgttgaccttctggtgggtcaatcagttcacattaggatacctgccaacatttggaagtacagagaataggatcccacacttatggggaggctaggcagggtatcatggagaattggaatgctgggccagtaaactgaggccaacaactagttaaaccccataaactggggaggactacctcttggagactgagatggttaatactgagtgtcaacttgattggattgaaggatacaaagtgttgatcctgggcgtgtctgtgagggtgttgccaaaggagattaacatttgagtcagtgtactgggaaaggcagacccacccttaatctgggtaggcacaatctaatcagctgccagcatggcagaaaaatgtgaaaagagagactggcctagcctcccagcctacatctttttcccgtgctggctgctccctgtcctcctacatcggacttgaagttcttcagttttggaactcaggctggctctctttgctcctcagcctgtagatggcctattgtgggacattttgatcatgcg

SEQ ID NO: 168 - DNA, 1977 bp, Homo sapiens
  cDNA CTLA4-001
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 169 - DNA, 525 bp, Homo sapiens
  cDNA CTLA4-005
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtga

SEQ ID NO: 170 - DNA, 969 bp, Homo sapiens
  cDNA CTLA4-002
tctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcacaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgaga

SEQ ID NO: 171 - DNA, 277 bp, Homo sapiens
  cDNA CTLA4-004
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtctaaagaaaagaagccctcttacaacaggggtctatgtgaaaatgcccccaacagagccagaatgtgaaaagcaatttcagccttattttattcccatcaattga

SEQ ID NO: 172 - DNA, 214 bp, Homo sapiens
  cDNA CTLA4-003
atggcttgccttggatttcagcggcacaaggctcagctgaacctggctaccaggacctggccctgcactctcctgttttttcttctcttcatccctgtcttctgcaaagctaaagaaaagaagccctcttacaacaggggtctatgtgaaaatgcccccaacagagccagaatgtgaaaagcaatttcagccttattttattcccatcaattga

SEQ ID NO: 173 - DNA, 2725 bp, Homo sapiens
  cDNA CD80-001
aagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtcccacctccatttgcaattgacctcttctgggaacttcctcagatggacaagattaccccaccttgccctttacgtatctgctcttaggtgcttcttcacttcagttgctttgcaggaagtgtctagaggaatatggtgggcacagaagtagctctggtgaccttgatcaaggtgttttgaaatgcagaattcttgagttctggaagggactttagagaataccagtgttattaatgacaaaggcactgaggcccagggaggtgacccgaattataaaggccagcgccagaacccagatttcctaactctggtgctctttccctttatcagtttgactgtggcctgttaactggtatatacatatatatgtcaggcaaagtgctgctggaagtagaatttgtccaataacaggtcaacttcagagactatctgatttcctaatgtcagagtagaagattttatgctgctgtttacaaaagcccaatgtaatgcataggaagtatggcatgaacatctttaggagactaatggaaatattattggtgtttacccagtattccatttttttcattgtgttctctattgctgctctctcactcccccatgaggtacagcagaaaggagaactatccaaaactaatttcctctgacatgtaagacgaatgatttaggtacgtcaaagcagtagtcaaggaggaaagggatagtccaaagacttaactggttcatattggactgataatctctttaaatggctttatgctagtttgacctcatttgtaaaatatttatgagaaagttctcatttaaaatgagatcgttgtttacagtgtatgtactaagcagtaagctatcttcaaatgtctaaggtagtaactttccatagggcctccttagatccctaagatggctttttctccttggtatttctgggtctttctgacatcagcagagaactggaaagacatagccaactgctgttcatgttactcatgactcctttctctaaaactgccttccacaattcactagaccagaagtggacgcaacttaagctgggataatcacattatcatctgaaaatctggagttgaacagcaaaagaagacaacatttctcaaatgcacatctcatggcagctaagccacatggctgggatttaaagcctttagagccagcccatggctttagctacctcactatgctgcttcacaaaccttgctcctgtgtaaaactatattctcagtgtagggcagagaggtctaacaccaacataaggtactagcagtgtttcccgtattgacaggaatacttaactcaataattcttttcttttccatttagtaacagttgtgatgactatgtttctattctaagtaattcctgtattctacagcagatactttgtcagcaatactaagggaagaaacaaagttgaaccgtttctttaataa

SEQ ID NO: 174 - DNA, 1491 bp, Homo sapiens
  cDNA CD80-002
ccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtagcctccgtcatctcttctgggatacatggatcgtggggatcatgaggcattcttcccttaacaaatttaagctgttttacccactacctcaccttcttaaaaacctctttcagattaagctgaacagttacaagatggctggcatccctctcctttctccccatatgcaatttgcttaatgtaacctcttcttttgccatgtttccattctgccatcttgaattgtcttgtcagccaattcattatctattaaacactaatttgag

SEQ ID NO: 175 - DNA, 771 bp, Homo sapiens
  cDNA CD80-201
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaagctttgccccaagatgcagagagagaaggaggaatgagagattgagaagggaaagtgtacgccctgtataa

SEQ ID NO: 176 - DNA, 737 bp, Homo sapiens
  cDNA CD80-003
cgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaaggttggtgggattttctgattttactctaggccggcagattcttaatgcccttaaagacacatggctattgatttaggtgaaaattttaccaaagagggatgtatctcacttcatttcttggagttaagtctctagttgtacaataaactctaactggtttctaaagatgtcctggaaatatctgttaatgtgcatttcttgttcttt

SEQ ID NO: 177 - DNA, 5048 bp, Homo sapiens
  2nd Promoter of CD80
tttggagggggagaggcgctctgatttctagaattttcagcttttctgctctgttttttccccatctttgtggttttatctacctttggtctttgatgatggtgacctttgatgatggtggggttttggtgtggatgtcctttctgtttgttagttttccttctaacagtcaggaccctcagctgcaggtctgttggagtttgctggaggtccactctagaccctgtttgcctgggtatcagcagcggagggtgcagaacagcgaatattgctgaacagcaaatgatgctgcctgatcgttcctctggaagttttgtctcagaggggtacccagctgtgtgaggtgtcagtctgtccctactggagggtgcctcccagttaggctactcgggggtcagggacccacttgaggaggcagtctgtccattctcagatctcaaactccacgctgggagaaccactactctcttcaaggctgccagacagggacatttaagtctgcagaggtttctgctgccttttgttcagctatgccctacccccagaggtggagtctacagaggcaggcaggcctccttgagctgtggtgggctccacccagttcgagcttcccggccgctttgtttacctactcaagcctcagcaatggcgggtacccctaccccagcctcgctgctgccttgcagttcgatctcagactgctgtgttagcaatgagtaaggctccgtgggcgtgggaccctccgagccaagctcggcatataatctcctggtgtggcatttgctaagaccattggaaaagtgcagtattaggctgggagtgacccgattttccaggtgccgtccgtcaccacttcccttggctaggaaagggaattccctgaccccttgcccttctcgggtgaggcgatgcctcaccctgcttcggctctcgctcagtgggctacacccattgtcctgcccccactgtccgacaaaccccagtgagatgaacccagtacctcagttggaaatgcagaaatcacctgtcttctgtgtcgctcacgctgggagctgtagactggagctgttcctattctgccaccttgcctcataatccttgcctgtgactcttgacacactgtcccccaacttccttggctgcctttccccattctctctgcccatctaaacatctttcttcctcaaaggaccaggccaaatgccatttccccaagaagctttcctgactcttctaaatctccatctgctctttcccttctctgagatcctatgtctgtgccactcatttggcatcattccaatccctccccacccccccaaatttattgagtgcctactatgtgcctggaagggttcaaacattggggaagcaaaatggcttgactaggagagataaggacaacatggaccgatcctaagaaaaagaaacagtagcagaaaaagagcagggcagctagctgaatttaagtctgcagtgtggcgaaaatgccaacaaaatattgcgagacatgagtggcaatatgacataccatggccagaaattatctttttggattctttctacatgaacccagatccttattggaatattacgtccaatttcaaactaaatgtggagaggatccggcagaaagtaacaaacaataacaaaaaggatgctaaaccaggcagctcagagaacagaggaatggggagccaagatgttttagatgggccaaatgattttgaggcctttggtaatgatcctctgtggctttgaggtgtttctgtttctttgttttgagctagtcatggccataaatgccttctacatctgtaggcgaccaaactggagaaaataatctacatgtaagcaggataaattttgattgtgtttaaggaagcattttttttgtgttgaagctggaaaaggtgactttcaaagaaggttgcaaatttttattgcctgatgctttaagaagagaagagacaaatcctgtttggggaaaacagagatttctctgcctgagagtaagggactatggtggaatcccaggcagtccacgattctaggacctgaggcgttaaatgtcactgccactggctgccactcccctgccctgccacactgtccaccagaaccactaacgaagttacaaaagtcacccttttcagtttctatttcattttccctgtcccctgagaaacaggaaccaaggactaggcagtaggagaagccagacatgatctatgctttcaaagtgggtcaccatggcgtgaatgaattagagctgaagggtcatggaaacagcctgttcctcctccctctctcctccccagctctgtcccccacttcttcctttttttgtattattctgaaaagtgaatcaaacagttgccattttttttatattacgttggtccacaacgtcaaaggtcatggtttccagatttcggaaaaggaatttgattctgttcctaaaattaaagagaaattgcaaggcttggatggaaaggggaagttccccttcaataactctttctagaagggtcaacatttaaaacttaacgtgtggccgggtgcagtggctcacgcctgtaatcccagcactttgggaggccaaggagggtggatcacttgaggtcaggagtttgagaccagcctggccaacatggcaaaaccccatctctactaaaaatttaaaaattagctgggcatggtggtgggtgcctgtaatcccagctactccggaggctgaagcatgagaatcgcttgaacctgggagatggaagttgcagtgagctgagattgaacaattgcactccagcctgggcaacagagtgagactctgactcaaaaaaaaacaaacaaacaaacaaacaaaaaaagttaaccttatgtagatatttacctattatttgaatacgagaaggaatttgaccacttgagggcctgatttatacaagtaccacatgatgaagaacaggattttatggagtgaagatccttaacagcactctcagattgaatctctcctgagccttgaactgatttctccagtggccactggggttgcgtgactcctccaatggccccagacacaactaagaaatgtgcctaaactggctgccatttgaaaccttttggtgtcctttgtttagatgccccaccctaaacttcaggagttctctccagagagtaattttaggaatgaatgccagagaccaagggatgagggactgttgcctcatcagagggggaaggagcttgctggaaaaacaagaggaacaaaatgtcccctgactagatttttctttaccttttgtctcaaggactcttctagaaatagaaataagagtagattcatgtacatttgcccaggttgaccccagtggaggaattgtggggcagaaagaatgataacatgaaagaaagataatttcagtaaggccccccaaacttttggtttagggagcagtcactttttgtttcctagaagctgtattttcacctactgagattctagcaggcagtgaagtccccttaggatgggaccgtgtgcaagagcattgctgtttcattgtaaaccctggaagcggaacttaggactcagctggccagctgagcttctcttcctgtgggaaatcccagcgaaaccaggagaaagggagcaacagaggtcatctgccaggaaatgtaccaaagaagatttgaaaattactggtggatctccagagcaaaggctggaaagccctgacctacaggagcgggctactgcattgttgggaggagcaggattcacatccacatggacttccctcgggtctctttctgctctgcagagaggggtggaagctgctcctagggttttttttttgttttttgttttttgttttaagatggagtctcggtctgtcgtccaggctacagtgtagtggcacgatcttggctcactgcaacctctgcctcccaggttcaagcgattctcctgcctcagcctcccgagtagctgggattacaggcatgcaccaccatgcccggctaattttgtattcttagtagagaggaggtttcaccatgttggccaggctggtcttgaactcctgacctcatgatccgcctgcctcggccttccaaagtgctgggattacaggtgtgagccaccgcacctggccactcctaggttttaaaacaccggtttgtatccacttatctcttttgctcctctccatatagtctcccatctctacctcttgctatatttgattcctgcctgcttgttagaattacggtgcatatcttagatttttctttaaataccacttttagactgtcatcaacaagaggcttaaggctctttgggagtgggatatagaatatttatttatttatttagagacaggttctcactctatcacccaggctactgtgcagttgtgtgaccctagcttattgtaaccttgaactctcaggctcaagcaatcctcctgccccagcttcctcagtagctaggactacaggtgtgcaccaccacacctggataattttatttatttatttattttgtagagacagggtctcactttattgcacaggctggtcttgaactcctgggctcaagtgatcctcccacctctgcctcccaacgtactgggtttataggcgtgagctgcgcccagcaaatattttaaaaattagactcaggaggttcaaatctttcataggtgtttagtctatcatgtcatttcaatttttttctaagtgacagtagaaggaatggaagaagtcctggctgggagttcagagggcatgggctccaggcccacttctctccatgtgtgaaactgagttatataaactctgagtaactgtcttcactggcctcagcttcctccctagaaagttattgtcagctgggcacggtgcctaatgcctataatcccagcactttgggaggctgagacaggtggatcacttgaggtcaggagttcaagaccagcctggccaacatggtgaaactgcctctctactaaaaatacaaaaattagctgggcgtggtggcgatc

SEQ ID NO: 178 - DNA, 5400 bp, Homo sapiens
  1st Enhancer of CD80
tccaagtgttctcattgttcaattcccacctatgagtgagaacatgtggtgtttggttttttgtccttgtgatagtttgctgagaatgatggtttccagcttcatccatgtccctacaaaggacatgaactcatccttttttctggctgcatagtattccatggtgtatatgtaccacattttcttaatccagtctatcattgatggacatttgggttggttccaagtctttgctattgtgaatagtgccacaataaacatacgtgtgcatgtgtctttagagcagcatgatttataaccctttgggtatatacccagtaatgggatggctgggtcaaatggtatttctagttctagatccttgaggaatcgccacactgtcttccacaatggttgaactagtttacagtcctgccaacgtgtaaaagtgttcctatttctccacatcgtcttcagcacctgttgtttcctgactttttaatgatcgccattctaactggtgtgagatggtgtcttattgtggttttgatttgcatttctctgatggccagtgatgatgagcattttttcatgtgtctgttggctgcataaaagtcttttttgagaagtgtctgttcatatcctttgcccactttttgatggggttgttttttcttgtaaatgtgtttgagttcattgtagattctggatattagccctttgtcagatgagtagattgcaaaaattttctcccattctgtaggttgcctgttcactctgatggtagtttgttttgctgtgcagaaactctttagtttaattagatcccatttgtcaattttggcttttgctgccattgcttttggtgttttagacatgaagtccttgcccatgcctatgtcctgaatggtattgcctaggttttcttctagggtttttatggttttaggtctaacacttaagtctttaatccatcttgaattaatttttgtataaggtgtaacgaagggatccagtttcagctttctacatgtggctggccagttttcccagcaccatttattaaacagggaatcctttccctatttcttgtttttgtcaggtttgtcaaagatcagatattgtagatgtatggtattatttctgagggttctgttctgttccattggtctaatctctgttttggtaccagtaccatgctgttttggttattgtagccttgtagtatagtttgaagtcaggtagcgtgatgtctcccgcttttttcttttggcttaggattgtcttggcaatgcaggcccttctttgttccatatgaactttaaagtagttttttccaattctgtgaagaaagtcattggtagcttgatggggatggcattgaatctataaattaccttgggcagtatggccattttcacgatattgattattcctatccatgagcatagaatgttcttccatttgtttgtgtcctcttttatttcattgagcagtggtttgtagttctccttgaagaggtccttcacatcccttgtaagttggattcataggtattttattctctttgaagcaattgtgaatgggaattcactcatgatttggctctctgtttgtctgttattggtgtataagaatgcttgtgatttttgcacattgattttgtatcctgagactttgctgaagttgcttatcagcttaaggagattttgggctgagacaatggggttttctaaatatacaatcacgtcatctgcaaacagggacactttgacttcctcttttcctaattgaataccctttatttctttcccctgcctgattgccctggccagaacttccaacactatgttgaataggagtggtgagagagggcatccctgtcttgtgtcagttttcaaagggaatgcttccagtttttgcccatcagtatgatattggctgtgggtttgtcataaatagctcttattattttgagatacgtcccatcaatacctaatttattgagagtttttagcatgaagggttgttgaattttgtcaaaggccttttctgcatctattgagacaaacctgtggtttttgtctttggttctgtttatatgctggattacgtttattgatttgcgtatgttgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgccaggctttggtatcaggatgatgctggcctcaaaaaatgagttagggaggattccctctttttctactgattggaatagtttcagaaggaatggtaccagctccttcttgtacctctggtagaattcggctgtgaatccatctggtcctggatttttttttggttggtaggctattaattattgcctaaatttcagagcctgttatttaaggatttagggatttaacttcttcctggtttagtcttgggagggtgtatgtgtccaggaatttatccatttcttctagattttctagtttacttgcatagaggtgtttatagtattctctgatggtagtttgtatttctgtgggatcggtggtgatatcccctttatcatttgatattgtgtctatatgattcttctctcttttcttctttattagtcttgctagtggtctatcaattttgttgatcttttcaaaaaaccagctcctggattcattgattttttgagggtttttgtgtctctatctccttcagttcttctctgatcttagttatttcttgccttctgctagcttttgaatgtgtttgctcttgcttctctagttcttttaatggtgatgttagggtgtcaattttagatctttcctactttctcttgtgggcatttagtgctataaatttccctctacacactgctttaaatgtttcccagagattctggtatgttgtgtctttgttctcattggtttcaaagaatatctttatttctgccttcattttgttatgtacccagtagtcactcaggagcaggtgtttcagtttccatgtagttgagtggttttgagtgagtttcttaatcctgagttctagtttgattgcactgtggtctgagagacagttcgttataatttctgttcttttacatttgctgaggagtgctttacttccaactatgtggttaattttggaataagtgctatgtggtgctaagaagaatgtatattctgttgatttggggtggagagttctgtagatgtctattaggtctgcttggtgcagagctgagttcaattcctggatatccttgttaactttctgtctcgttgatctgtctaatgttgacagtggggtgttacagtctcccattattattgtgggggagtctaagtctctttgtaggtctctaaggacttgctttatgaatctgggtgctcctgtattgggtgcatatatatttaggatagttagctcttcttgttgaattgagccctttaccattatgtaatgaccttctttgtctcttttgatctttgttggtttaaagtcttttttatcagagactaggattgcaacccctgcctttttttgttttccatttgcttggtagatcttcctccatccctttattttgagcttatgtgtgtctctgcatgtgagatgggtctcctgaatacagcacactgatgggtcttgactctatccaatttgcccgtctgtgtcttttaattggagcatttagcccatttacatttaaggttaatatttttgtgtgtgaatttgatcctgtcattacgatgttagctggttattttgctcgtcagttgatgcagtttcttcctaccatcaatggtctttacaatttggcatgtttttgcagtggctggtactggtttttcctttccatgtttagtgcttccttcaggagctcttttagggcaggcctggtggtgacaaaatctctcagcatttgcttgtctgtaacggattttatttgtccttcacttatgaagcttagtttggctggatatgaaattctgggttgaaaattcttttctttaagaatgttgaatgttggccccccactctcttctggcttatagagtttctgctgagagatccgctattagtctggtgggcttccctttgtggaaaacccgacctttctctctggctgcccttaacagtttttccttcatttcaactttggtgaatctgacaattatgtgtcttggagttgctcatctcgaggagtaacttcatagtgttctctgtatttcttgaatttgaatgttggcctgtcttgctaggttggggaagttctcctggataatatcctgtagagtgttttccaacttggttccattctccccatcactttcaggtacaccaatcagacgtagatttggtcttttcacatagtcccatatttcttggaggctttgttcatttctttttactcttttttctctaaacttctcttcttgcttcatttcattcatttcatcttccatcactgacactctttcttccagttgatctaatcggctactgaagcttgtgcattcgtcatgtagttctcgtaccacggttttcagctccaacaggtcatttaaggacttctctacactggttattctagttagccatttgtctaatcttttttcaaggtttttagcttctttgagatgggttcaaacttcttcctttagctcggagaagtttgatcatctgaagactttttctctcaactgatcaaagtcattctccatccagctttgttctgttgctggtaaggagctgcatacctttggagggggagaggcgctctgatttctagaattttcagcttttctgctctgttttttccccatctttgtggttttatctacctttggtctttgatgatggtgacctttgatgatggtggggttttggtgtggatgtcctttctgtttgttagttttccttctaacagtcaggaccctcagctgcaggtctgttggagtttgctggaggtccactctagaccctgtttgcctgggtatcagcagcggagggtgcagaacagcgaatattgctgaacagcaaatgatgctgcctgatcgttcctctggaagttttgtctcagaggggtacccagctgtgtgaggtgtcagtctgtccctactggagggtgcctcccagttaggctactcgggggtcagggacccacttgaggaggcagtctgtccattctcagatctcaaactccacgctgggagaaccactactctcttcaaggctgccagacagggacatttaagtctgcagaggtttctgctgccttttgttcagctatgccctacccccagaggtgga

SEQ ID NO: 179 - DNA, 5324 bp, Homo sapiens
  2nd Enhancer of CD80
aatcaaactgaggtttagagaaattataactaaccagtaatggcagaattcaaatctgtctgacaccagagcctatcttttcttgaccttgcctttctttctttcctttccctttcttctcttctcttcttttcttcctgatgcttgaagtacgcaagtggctttcttctatgttatctatttatttactaaactatagcgaacgcctgaaaacccaccatccaacttgagaccaaaaacactgacagtaacttaggtaaatctgctggtatgatgtcacctatcctgtccctctctttcccttacctaaggtaatcactatcactatcctaaatttgtggttagcatttccttgctttttaaaaggtcgtcttttacatgaggggcctacccctttgctcttgagaatggtttctcatgtcctcctttctggccttatcctttgaacattgactcttaagtctgttacaggtaagggctccatgaagttgtgtttcccttttctttctggctacctaaactcaatacataaatagagaaggctttgcctaacatagaactttcgttggaaagggtctagatggggagagagaaaacataaatctggtcaaggagaggagatcttggagaaaggaaaatgctgcctaatttacaaacctgtgacctgccttttgagggggcattgtgtgcgtgtgagtggggggcaggcattgaactatagtcatgagcttttgcttctactgagtctcaccaacaccccataccccaaaaaaacacccatgaccagtattttttaatttgcatatttatttctggatgggttttcccctctttattctgtcctcatgagaccatgggcaaagctctttattttaggtgagaagaaaaactctgaaccacatcagtaatgttttcatttgaaaatatcattgaaatgtatttgaataaatttatttgaattcatttgaattttttaattattttgatagtagacatgctgtttatttatttaatgtgcatatggaagcctgaaaaatagaaagctgtatagactgagtttagttgttaattggtttgggagtcttccatgcataatttatgacttcttggtgttctatatatttgtccgaattaattactgggatgaagctatgctagctttcaaacaggagatgcctttcagaaatttgtatattgtgcagttgccagaccaattaaatacctggttgaaattaaaaaaaaaaaaagtagtcttttactcagaaaaacctatatccaaactacaacattgagcctataacctcattcaccacactttattgtttttcttactattttgatatgccttaaagggacaggaaggccttcctagcattcctccaagacccttgaggcactgtttcatttatatatttgatccccataagattctgaagtacaaagtacaggaaaataaatgcagagaacataggagaaagatacctagcggcttcgtcacttattcttacacataaagagattagcttcttagcatgaatgtagggattcaatctcctcatagagttagctttcttttcagaattctgagccccacagagatgtcatgtagcatatggtcatcaaaagcaggttttaaaaccagttctgccttgtgaccctgggtcaataacttacccacctttagtcttagtttgctcatctataagatagggacactaatacccagggttgtaagaattaaatgacatcgttcatagaaatcacttagcacagagcctgacacacaggaaactaaatagtctcactctgttgcccaggctggagtgcagtggcaccatcttggcttactgcaacctccgggttcaagtgattctcctgcctcagcctccagagtagctgggactacaggagcccaccactaccatctaatttcttgtatttttaatagagatggggtttcactgtgttagccaggatggtctcagtctcctgacctcgtgatccaccagcctcggcctcccaaagtgctgggattacaggcgtgagccaccacacccagccaatgatagctatatttaagtgggtcttgaatttatcctctcttaggtaagccccctcatttaaatcaggttgccaggcaaacacttccaggaatgccttgtggcacctacaataatgaggataaagggaagccatgacaaatgatgataattgccaggaaagaggaaaagttggatttggttggaggtgaagttaccttttttttttgtttgtttcaatgaaccctgtccctaaatgaagtttgatatgttcctgagccacttttagttggcattgttatttcccacttattaatttatcctataagatcgactcatgacacaggcagctgatatctagaatattctgtgtttcttataacatcaatatgttttgtgttataactaggaataataaatccaaaaactcatatcctaaattattaatatgattcatgttcatttctgtgctctgcttttctgggaaataaactacaggaatgccactcataccaggaactgtattaaaaatcttttcaaggccaggtgtgctggctcatgcctgtaatcctagcactttgggaggtcaaggcaggaggatcgcttgaggtcaggagtttgagaccaccctggacaacatagtgaaaccttgtctctactaaaaataaaaaattagccaggcatgatggcacatgcctgtagtcccagctagtttggaggctgagacaggagaatcgcttgaacccaggaggcagaggctgcagagacccgagatcacgccactgcactctagcctgggtgacagagtaagagactccatctcaaaaaaaaaaaaagtttcaaaatctttcttggcttagaacagcctaaactccatctcccaccttttttctaaggtgatctgtttagggtaactactcctgaggtcttgtgagattgtgaacaatcaaagacgttgtaagactgtaacctttgtatctcattttaattagttaacccaatttttaccactcttaataggaaagggtaggaatgtcttacaaggaaaggaataggtgcacatgttttaggaggaaaaatccattaacctagttaagctgttaacgaatgtagctagttctcaaacatgccagttaatggaggttttcatatggctatgctgatattatattaccattttgcaatcttagacaaatatagggtaaccaacgtgtcctatttgcctgagactttcccagttttagcaccaaaaatcttgtgccccaaataaaccctttggttctgagcaaagaggatacctggtcactctagccaaatgagagcttaattccttgcttctcaaattgtggtcctccacagcagcacaggcatcacctgagagcttgttagaggtgcagaatctcagatccaaaccccagacctactgaacttaaatctgcatttttaacaagaccctcaaatgactcataggcttataagcatttgagaaacactgctttgactcaattggaaaattcagaatgcttctcagcaaaattaagcgagtgacctttttgtcttccctttactggattttgtccacccacacaccctcggttctgagtaccccagaaatctcacattgtccccttagctgtccttggtctcttacggtaatctgctaatagggcctgccccccttgaaatgtttccttttctcactcttggattttcttctttatctttctatccaaattcacctgacctgagtctacttctctctcggtagtccattagaggactacgtacctaatgtaattaactaatacaggctaatatatttgtggtgccaccccccaccccccaccccaggaaacacattttcattttaacagggatcttttaggaggaaaatggagaaactagcaggaatggctatgatgatgagaatttcaggagtcaatgcaggtgaaaatcgtggaagaggtaggcttcttagtacccctcaaatcacatcaccatataataatttattctatccaagagcagagaaaacactgagtgaagtttaagatagttccatgtaactttggcttactccccacaactttaggtgtgatctggatgtcacaagtaaagattcatagctaatgattaaaacaaagaacagtaaggaattcactacggatctgctgaagttatctattatcaaggttaatcattatgttttattaagtaagaagtttggttttcactagaggctcaagtcccaggggaaaaagaaatatgttcaaatttcaactgtgagaaaatggctcagggatataatttctcaaaaagggctctggctccttcagtatcctctgttatactgtaattaaagtgaaaccccctttgcaaaattatgactgagacagtgaaagagatctaacttaactgactccatcttgcttctaacctccaagctatctttgttcactcctgggtgtaggctgaactaactttggtagaaacttagtttatagtttatagtttaaacaaagatggtaacagccctttcccaaagcagacctccttcttgcctggggagtagattgcctttgtaggactaacattagccacaagattagaaattatggtttaggagtcataaagctggatgctatgagattctgaccctccctaaactgctcctaagatcagtgcttgagctattttgcagcccctgcacttgatggatcagctggcaccacccagatcaataaactgactcatctgatcttgtggccccccaacccagtgcaagaagacagcttcaactccctatggtatcatccctgaccaatcagcactcccagctcactggcttcccccgacccacctagttatccttaaaaactctgctccccagatgcttggagagactgatttgagtaatgataaaactccggtctcccgcacagccagttgtgcgtaaattactctctctattgcaattcccctgtcttgatgaattggctctatctacgcagcaggcgaggtaaacctcttgggtggttacaaaagcaagggtcctttctttccgagaccagaaatgcttgccttccacagtaggtacataaacagggctttgattcataaattagtttttttccttgtggcaggaattaattatgcatccaattctctaacttttttttttttttaagacagagtctctaccagtagggaaatgctcaccctcctctgtagtctactttttttttttttgaaacagtctttgctctgtcaccaaggctggagtgc

SEQ ID NO: 180 - DNA, 8486 bp, Homo sapiens
  3rd Enhancer of CD80
tctcttcaagaccctgctttcaattcttatggatatatggaattttggggtcatatggtagttctatttttaattttctgaggaacctcaatagtgttttctatagcagttgcacccgcaatgcttgttaaaggttttggaagtcactatctagaaaaactaaatgtgattgcataaaaaacaaatttggttttgaaaacaatgaagacaaatcactaaaatcagactcatggaccaatcattataacataacctatccccttcctttttcttgagaattttccaatgacatgcaagatttaggagcatatgagccttctctcacagcaggcaatttttagtcctattacttcttatttggtttacctaacacaataccacccccaagagaagtcagtcctgactaaggttctgggtacagtggtggtggaggagggcaaggtgctgttgcccacctctgtctagatagcctatattgaattactcttcatactatttcctttttttgcttcctctgtggtggctctatggaggggacaggtgctatgtcatttaatcccccaacaaccccacaagatatgtattattttccccattttgcagctgagacaactgagagattgagaggttcaggaagtctaggacagggcaggtcagcctgagattccaagggcctatgattctgcagtcatgacgaagaataagggagggagatgaggtcaactaagaagaaaaaagagggccatactttaaataggtagggaatataatcaatcttcattattcatgaattctcacttacagaaggcctccttcttggatctgttgcctggtcacttgattaggtaattttcagctactactgccttgagaaataaggaagaatttcactgtaaagacctagtctctgatgctcactgccttttcccttgcgtttctcctacagcccctctccccacaatcacgtgatgcaacaacacacacacacacacacacacacagatatgcacatgtacacgcattcatttaaactacagaactgcatttaaccgtgggaaaaatctaagaataaattttatccagattaagtgagctaaagacaatccatttcatgtgacttcagtggcgtggcacaggaataaaaccttcatctgtcaccttaatacacatcctgattcctccccttttcacttgagtgacttaggatttaaagctctcaggactgcctacttccctacctaccttaaaggcaaccatgactaagtgcaccctgctaacatccttgcctagaggctcctggttgttggtatagaaagaacatgggcttttttcattcaataaaatccacagtagttgtgtgaccttaagcaacttactttacttctctgaaccccagtcttcacattggttattatgaagattaaatgagataatttatggcaagcacatactgtaattcaatgcctagacccacaccaaatatgaatcccattctcctttctccaagggggtggggaatttaccaacctctaaggcttttgatttcgtctttggacaatttgactgaggaagttttgctttgctttatgttgaagtctgtttccctctagcttctacatgcattacaaaacacatctcattcttcttatgtaacaagacttgcagatatctgaggatacttatatcctctctcagacagttctgcaggttcccatctgcccctgttccttattgatgtactgaaagtgagtaccctcactttcctcactacacagtttgatttgtgtgtatatttttttgagagagcgaagtcactaaatctagcattccagacatccactgtgtgattggctcagagtagaaccgggttgtcacttcctttacctaaatctatgtttgcagcctaaagttgaattcaatatattagcagccaccttacacctttgatataactattgatatactgacaagcaaattgccttatttttccacctatacataccactgtgtgctgctcctacatccagttcaacaccccaccaaatgggtaaagctcttccagtgacgttatctttcaagagttatccagaatcttccccttccctgaatctccataagacgacacatctttctttcttttttctttttctttttttttttgagacggagtcttgttcttttgcccaggctggagtgaagtggcgcgatctcagctcactgcaacctccacccccaggttcaagcagttctcctgcctcagcctcctgagtagctgggattacaggcgcccgccatcatgcccagctaatttttgtatttttagtagagacagggtttccaccatgtttgccaggctggtctcaaactcctgatctcaggtgatcctcccacctcagcctcccaaaatgctgggattacaagtgtgagccaccacgcctagcatgatgagacatcgtgagcattcagaaatatggaaaggcacctgcttgtcttatgtatatagccagatgcctatgggccaggagttggggacagagacagggatccctagtgagtgagaaagtccactggtcccctgagaagacctgaatataagtgccaaccatgggttaaacgatgtgctcagccccaggggatatgaaagtcatagtaaggaatgtgagatctggaagggacttccatgatcattcattctcgtggccttatcttacaaatgaggaaactgagctgaggaaaagaaactgccccagttttacacatttttttctttctggcccaggcttttagggccattcttcttgtttaccgatttcttcagttttaggccacagtcagtaagttaagccaacactgtccccacccaccccaatccagccctaccactgagcccttttgctataagaaacagagtcccaggccgggcatcatggctcaagcctgtaatcccagcactttgggaggctgaggtgggcagatcacgaggtcaggagtttgagaccagcctggtcaacatggtgaaaccccatctctactaaaaatacaaaaaaattagccgggcatgttgggacacacctgtaatcccagctacttaggaggctgaggcaggagaatcacttgaacctgggaggcagaggttgcagtgagccaagatcacaccactgcactccagcttgggtgacagagtgagactccgtctcaaaataaataaataaataaataaataagaaacagagtccctttctttccaggcctgattgatcccatggttccaggctgaaatgactcccatgcttatacctttggactatttctaccatcttcaggtaccctaaatggatcctatatcctgcctttatctctttggctatctgcagtccatgccatacaattaccctccagcctggatttgctaaaagagtttttatttaaaatattctgttcatttctccatccacatagccaagaaatatcagcatatcaatatctaaactagtctctgtgtcaatagcaccaaaattccttagcaggctgtattttctgatttttggtttagaaggcatggtcattcttcctaggctcttgtaggacctaaaagcagcatccctctaaggccccagcgccccctgcccagtgctgtcgtactgtgccttctgggccctgtatcccctggagccacacagatccccttagggagacccatgtctagggacttcatttccaagccctctcttttcttagatagcaggatcatggggcactagcacctttccatctcaccagccattctcaggcctctgtcagactggatacggccccaccacagcactgaacaagagagttttgtgatggtgggtatttgcatagcaaagtgaggtaatgcagaaaggtccaggcacctcttcagcaattgtgtggaatgttgccagtccctgctttagggaatataactgaaagaaaggaagaaataaaaagacatacttgaagggagcatatttcaaagtgaagctatattagctaaagatcaaatgacaacccagacactcctagtgttgcaaggaaagcaaaatgagacgtagaaggaacatgggctatccatctccattgacttggattctagtcccagctcagccacttgctgtttcatctgtttcttcatctctaaataggtatgacacctaccccttgggatcactggaaaattcagttcaattaaatgatataaataaaaagtcccaaggacatagcaggtcttctgtaagagtttccatttttctttctccctcctcccactgccaactcttacctttcatttcactcaagggttatgtcagatatatagcactctggtcttgctatgggccagacagacagcaactcacttgtctgggcctcccaataatagggtctttccccaccgaactattcattcccagccaaaaagaatccaatatttctcactgattttggtatgtggtgatgttagcaaaagtgaaagcatagctgaaagagagactatctaattttggtgatggcttctgaggagtttttgtccagccttctgaggagaagagtgaagaagaacaggactaaaaagaggaacccaaaatcttccgaacaatttggaaattcacacgggaacccagttttcgggattccaccacacagagacagaaaacagtcattataaatttgcccaaatttatatcagttttgtctgttttagggactccatcacacacggacaaaaagcagttgaaacggaaatgtctctaacgattttgtctgcttcagtgactggcggggaaagtcagcacctggaaatctcaatattactgtctcaaacctggttgaacttctgagcttgctttgccatttttgaatgggcattgtaacacctacccaacccagtgggtgcaaggattcaaaatgagatactgctcataaaagtcctccacagtacctaggacattagagggagccagtgtcttccccagagatccacacagttcaggtcccactttgctcacatctactctcgtggccccttgtcaaagaggccttccctgactctccttgaacagcgccatcctccctgcccccctccatcctgctactctttagtctctttgcctgatttgtttctcttcaggcttgtctccagctgatatatatttttacaactgtgatgtatatttacaggtatatgtgatacataattacgtatggagctatggagcagaggcttcctcctttgttcactgccatatctgcagtgtctagaacagggcctggcccatagtaggtgctcagtaaatacttgctgaatgcatgtctaggcatgaggaaatgaggtctggctccatccactgtgtattagaatcataaccttgagcaagctgggtaacctctctgggcttcaggttccatctctgtaaaacagtcataatactattgctatgatttgaatgtgtcccctaaaggttttgtgttggaaatttaattccgggtgcaacagtgttgagaattgggactgttaaaaggtgattaggtcatggagactctgccatcatggatggattaatgccatttttttgggagtgggttcactacagcaggagtggcttccttataaaggatggttttggcctccttcctactctgccttgggcgtgctctcctgcctttctatcctctgccatgggatgatgcagcaagaaggtcctcatcagatgtgagccccttgaccttggacttcccagcctccagaacagtaagaaataaatctctgttctttctaaattacccaatgtcaggtattctgttatagcagcacaaaccagaccgagataactatcttccctgcttcacataattatcacagcgatcacaggataccagatgtaaagtgctttcttaactttagaatgctctacagattttaaatggggctgttctttctcatgcacaacagcctgctttgctgaaccacacccccataggaccagcatcaccatggtaactggctgattcttgaactgagttcagtgcccatagctggcatggggagcccctcctgcacctctacccagcagcagtcagaaagggccagaggctgtgaaaggaggcggagagaaggcagagatggacggcaacgctgctcgccttctggcgaatgcatggaaactgcccacctgtagggcacaatagggacactcaacactgctggcctcagcctctgcctctcctgaccccttggccaccctcctgctctgaccacttcaactctggactgctagccacacaggagaggaagctatttgccaacaagagtagagaccaagaattttagacaaataatggacctctcggccgggcgtggtggctcacgcctgtaatcccagcactttgggaggccgaggcaggcggatcaggagctcgaagatcatcctggctaatacggtgaaaccccgtctctactaaaaatacaaaaaaaataaattagccaggcgtggtggcgggctgatttttgtgtggaggacttttacgagctgtagtcccagctactcgggaggctgaggcaggagaatggcgtgaagccgggaggcggagcttgctgtgagccagagattgtgccactgcactccagcttgggcgacagagcaagactctgtctcaaaaaaaaaaaaaaaaaaaaaaaaaaggacctctcaagggctcaatctaggccaggcacccgtaatcccagcactttgggagctggccaaggcgggtggattgcttgagcccaggaaatcgagaccagcctaggcaacatagcaaaaaccccatcgctacaaaaagaaaaaatagatctcaatctacaacagaatattatttcagaatattatttggccgtaaaagcgaatggagtactaagacatacgcaacatggatgaacctgaaagacataatgctcagtgaaagaaaatagtcacgaaacgccacatattgtaagaaatgtccagaatattctttcttacctggattctggaaaaaaaggaagagaaaagaaatgtctagaacaggcaaattcatagagacagagagtaaattagtggttacgaggagatggggtacaggggaatgaggagtagctgcaaataggcgcaggtttctttctgggatgatgatttccatcatcatccagaacatttccttctggaattcgatagtgatggtggtttcacaacattgcaaatatactaaaacccactgaattgtacactttatttatttatttatttatttatttatttatttatttatttatttatttactgaggcagagtctcgctctgttgcccatgctggagtgcagtggcatgatcttggctcacagcaacccccgcctccagggttcaaaagattctcctgcctcagcctcctgagtagctaggattaaaggcacgggccaccttgtgtggttaatttttgcatttttagtagagacagggttttaccatgttggccaggctggtctcaaactcctgacctcaggtgatccacccatctcggcctcccaaaatgctgggattgcaggagtgagccaccgtgcctggctgaattgtatactttaaaacgttgaattttatgtcattgcaaataaaacatgaagggaaaagaagaatccatactaggaagacctgagtcttccccaccctctccgtgcagcctggaggcctggaggatgcagtggccagtctgcagtgcccctcccagggagttcaacctcagcagccgttagagaggctgccctcgcaggggtctgggagctgcatcaccactgctagtggagaagggagagaagcagttgacacaacatcttttaactcaccaaatgacgggacatacatgatctccctggaaacacaagtgtgctttttaaataaacattttccctgactatgaaataaacattcttagaaagaatggaagatatagaaaagcgtgaaagtcacctattgtctcaccacctggagattttaccgttcctggtttgtgcacactcttccaacaggagtgacccccctctaaatgtttgattaggtgaactagcaccgacagggctggtgtcagccctgggctaggtgctagccacacaaaggagacaggcagagctgcctctggcagccacaggcttgagacctgtgtctcctcgtgttcacactgttcctgacttttccccctgtttagaccctgctcatatactctgtaccatctgatccttactttttctctttctaaacagtatttatatccttaaaatgcacagggacttgaacagctgttgtcagggtgatgatggcaacaatcactgctcatgggacccctgggccagcagcatagcggtgtgtgttgcagggagaggaggatgtgttctgtgaatggtggcactttggggtattctcttttctcctagctctgagttctcagactataaacttata

SEQ ID NO: 181 - DNA, 30553 bp, Homo sapiens
  Coding Sequence of the CD276 Gene
ctttctgggctgtggtgccagcatggtgtggaggaagaacccaagactggggttggacagcaggattccagccctgttctgccgccagtcgatgaccagtcagtcacctatcccctctcgcagaaaggaagattcggctcttggaagtgtgggaacggggtgggggatgggcagcgccctgctccgggagccgagggttttccccgccagggtcaggcctgggggcggggcggggcgggggcgggggccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgccagatagccgagatgtctcctcctctgtgcagtccttactgagcctccccagcccccagtgaatggcttgaccctttcatccaggtttaagcctactgcctcgtccattcccacaataccttgtataaatgtgtaccaaaaaactggtcatattctattttaatgatatatttgtttcctaaaccttttttctatttttaatatgaaaatgtgggattttaaatatgccatttagcagctctgtaatcttgagcaagttattaaatctctccatccctgaatttactcctcggtgaaataggataataatagtacctacttcacagaattgttgggaagcttaaatgagttaatatgtgtaaaagcatttagaacagagcctggtgcatggctttcaacaaaactggcctatgttattattatttgataaaagcaaaataatatatataacatgggtaacttttgaagcataataataaacatacctcccaacttgagaatgagaacccctgtagttgaatatttatatgtacgattcttcatctccattcatattgcatgcatggccaatgcctggcatgtggatcatgaataagcatttgttgaatgaataaatgaacaaatgccagaagacttgagacagggaaataaccagttttatggggaagatggtagattatgggaacaacagatcgataatcttgttcttaatccttgacaaagtcctggaaccaatgagcacttgaagaagagcccactagtaggcacttgcatggcttcactggggttttgaaaatgcacttcttttcttgttcttctccagttgattggtccccagccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgctgggattacaggcatgagccactgcactcagcctgaaatagcctcttaactggcctctcccttgccctgatacaatccagtctatgctgaggagctagagtgggttttaaacattgttacctagattatgtgtgattaaaatgctccccagtgattcccattactcatagaaaaacccaaattcctcactggtctctcaaagccctgcttgatctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcacttgaggtcaggagttcgagaccagcctgatcagcatggtgaaaccctgtctctactgaaaacacaaaaattagctgggcgtggtggcatgcacctgtggtcccagctacttgggaggctggggcaagagaattgcttgaacctgggaggcggaggttgcagtgagccgagacagtgtcactgcactccagcctgggtgacagagcaagacactgtctcaaaaaataaataaaataaaaataaagtgatttcattgaggccattgttgccaagcacatttcacagacgaagaaactgaggtccacagagaagggggaactttcccaaggtcacagactggcacagcggctctcaatctttgggggtcagacccttctttgaaaattggataaatgatcaatgcagcagtttgcacataactctggagggttcgctgcctctctaaactcctccgtgggtctgtagacctgggctccagtgccctgcagtgaggagatgagccatgatcagaatccaactttggcctctcagcctaatttcctctccttcccaccagccagcctcctgtttctgttagagcaggtctggcctactttggagcccttggcctgtattttgcttcgggcagctttgtatcatgtcaaacattctgggattcagactttcagtcctccagctggtctctcccgtacctgatgaagttagtgaagttgtgtgctgtgcagagcctcttggagggggatttatggagcaagccctagagacgtggcctgagcctgtcctttcttgggtgaacagggcaaatgtaatttgtgttccagggacaccaccagttaagggggaacatagagaccctctgcttgagtatttccatggctctgccccctcctctgctgtcagagccccatgatgggatttccagggtggttattgttttttaatgtgtgctctgtggatgggccctcttggccacatcagctgctgccctccttttctgcacacctctcttcatcactggggtgatggatccctgtgcttccaatggccagagcagcagttttgccagcagtgcctattgaaggtgacatctgcagatccatgcacgaggtgcatctatgctggggtctctgccgccaaagggtccatagcaccgcgcactgcactgacagggcctcctgcagaagctgctgaggccctgggtgtgcatcgtctccagacagcaaaggaaagcagcactgtcttttgtcaggcttttcctctcaagacttctccctaggacccagctgggtgcaggggctgggctagaggatggtatgtaagatggagtcacacaggctgtgctcagaacagctcctggccctacccagctttgggtcctcaacttcatccctcttgacgtgacagctctaagaggaggggcctcagtgtttcatgttaatatccccctggcaaggcccctgcagacctacctgactccttggggaaactccaagccctcactccagccccgtcagtgacctcatctgtatgtaggactcagcgaacattttctgtaaatggccagggagtaaatgtttttaggcatcgtgggccacacaccatctctgttgctgctgcttctccttctgttcctcctccgccttcccccatctttttttggtaaccctttacaaatgtaaaaaccatcactagtttgtggactgtacaaaaacaggccacaagccagctttggcccatgggctgtagtttgctgccttctgatccatagaatgggagatgtcaccaggtagggctgaagcagtcaaaagagggcctctggaggaggtgaatattgagctaagcagagaatttgggaaactgatagcattagtgcagaggctggaaggagccagttgcttctggagagaatggttaggacaccagtttggctgaagctgaggctcctacagtagaattagaaaacttaggggagggtaagcagcagccaacttctagaggtccttgaatcacgcttgaagcttgaagcattattctaaagtcactagggagccatagaaggtacttgagcatcaattcaaccacaggctcttcagcccttcctggttgaggcgtgtccacatcagccagggttgtatcagggtttggggagtgtatggcgaagggactgtaggaacttaagtgagctttattcatagtgttagggcccagtgagggtgggagcccctgttcacacttggagccaatggtgctgtcctccgggacatggggccaggcatgacagtctcactgttgctacttttcctctcagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatgaatgtggatgagtgtgactggaaggtggtgggagtgtaaggccaagtgctacaaagggatgagtgtgtgccaacaagtgtgcctgtgaaagtgtaagtcagtcacgtgtgtgtgagagagcaggccagagcatggaagctgtgcggcacaaatgtaggcatgccaggggcgtgcatggcactgggggtgatcgtgcctgccttggagtgagtttgaagcagctgccatttgcggggctgagggtcagcccgagctggcattggtgactggtaagtgggtgagaggacattggtgggtggtgagttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggctactgagcgagcggatgggtgaggtgatgggtgggtgggctggtggagggtaggtggatggtctttggctgggtgtgtggcgggggctccaggttgagtggatggtctttggctgggtgagtggtgggctccaggctgggtggatggtccttgactgggtaagtggtgcactccaggctgggtggatggtctttggctgggtgagtggtgggggcgccaggctgggtagtttttggctgggtgagtggtgggctccaggctgggagccccttcatgttgtcacaggctcggctctgctgtgctctgctctcgggctctaacccgtgtctagcatttggtccgcaggtcaggcccactcaggccctgttcaccagcttcctgcactctcaggtgggaaagtgctggcatgaaaatgggcttgcaaaagatttttgtttattctgagttcttgcctttgcaggagctgaggaccaggatggggagggagaaggctccaagacaggtgagtctgaacttggagctggccctcttggctgggagagggacatatgggaaaggagagaggactctaggatctggaggggccagatttgctgtaaggtttgaatgaaatgtgttctgtggactcagacctccccaccccggtgagtctgctctttgcccagagttaggcaggaagtggatcacccagttccctcccaggtgtggcttcatttctcctgccaacctttacccatctgccagggccgattccacctgattggccccacaccgtggagtctggtggcttcctaggggtgggagcaggggctccggagatagggagtctgggtttaagttcctgctccatctcaggtaaacagagtggccttgagcaagatgctttgcctctctggcttcggtttcctcttatgtaaaatgaggataatcacagattcataggttgtttgaattattaattgagataatgtatataaaggacctagtatcatatctagtgccaagtgcttaatactctggagtcctattactattaggcaaacagcttaagacaatactgttctagttacagactgtgtagctttgggcaaggtgccttgctcctctgggcatcagtttcccatctgtaaaatgtcatcctgaccctgccctgatggcaccagagggctgttttgaagctctttcaggtgactggagagggaggtacttgcaaaggacataggagcatggcacagtaagctgggggcccagcttgggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 182 - DNA, 12654 bp, Homo sapiens
  1st Promoter of CD276
tttagtttgttctgttgttttgttgttttgttttttaaactctgtacaaccctcctatttggaggacctgccaccttccttccgactcaccagcagcaggacacaaactctgaaatggcttcccggtattgggagtgttgtcagccaagattatagtaaagaaattggaaagggaaaggggattgaatggttcagtttcaccggggatggggaggaagacagataatggaaagggtgaacagggaagaagagcagaggctggtgagtcagatagaagcagctagttagaaaagactgcttagaagctctttcgttatgttgttgtgtgtgtattagggccttagggttacggagtgttcccaggcgatcctccctggaggacctgctcctctttcattaggctgctcctgttattttgcttgccagatgcttccagctggcagtagttggttctagacatttgaagcctattccaagactcaattcccaggactaagaaactaggaagccggaacctgcagtggttgctatgcaccatattcagttttacaccggattcagtcatttgagagaaatgtggttgccttaagtctaggctggatggaatggttcctgatggcaccctatgagtcctaagtgagtgggcagagtggagtgcgggtgggtggcttttgccaagacatcaaggatttgaggcctaaaaatgcaaacaacttgggaagtaatatgcaccaaccagcctgagggaagggaggccagtgccaaggtattggcttagtgtcgcagggatcctcgataaaatccccaatcgccacttgggccttaaatccctgacactgccaagaattgatttttgtttcttatggaagcagtcaaaatgaatacattttcagtatcattcttaggagaggcatctcaatgtttctgagccgctttctatgagatggactgcttagctgctctaaaaagacagaaatatctccatagcttacactgtacagtttgcattatctaagtgtatttaaatagatgagagagacactttcccttttgcatgtcaaaggaggcaaaaggaagttttctcctaatttcagtcataatttctgccctgaggaaagttataatgttctactgtatggatacaccacattttgcctatccattcatctggagatgtagacacttgcgttgcttccacattttgcctattgtgagtaatgccactaagaatatgagtgtacaaatatctctctgagaccctgctttcaattctttggaggtatgcccataagtggaattgctgaatcatatagtagttctatttttatttctattttttgagacagagtctcactttgtcacccatgctgaagtgcagtggcatgatctcagttcactgcaacctccgcctcctgggttcaagtgattcttctacctcagcctcccaagtagctgggactacaggtgagcgccaccatgcctggctaatttttgtattattattatttttttagtaaagatggggtttcaccatattggccaggctggtcttgaactcctgacttcaggtgatcctcccgccttggcctcccagagtgttgggattagaggtgtgagccaccttgcctggcctatttttaattttttgaggaactaccagactggtttccatagctcaaggctgctcctttaacaagctttccccaaagcctcaatcagtgagtttcatttccatctcatttgccacactgggtcacgtgactgcctctagctgcaagggggtctgagaacccacgtattttcaactaggcatagaacttcttagaacaaatgctacactctgttggtaaggaagaagtagagaattaattttagtggacaactagcagcctaagggcaaatgagaacactgaagggcttcaggtaagcaagagacattgtgggaggatttgcgctttagaaggctctctctggcagctatggactgaggagtcacagtcagcagaattagttaagaggcttcaacaacaatccagtgaggagtgatgggggttcagatgaggatggtgtggcagtagggtattcaggaaagggagggattcctaacatattctagggcaccccttcaagcctgcctggatattggcagtgggaagtggggggaagtgggagggaacgagggatgagtccaggttttgagcatagtccttcctgtatatctagaaggggaaacaggttttggggacatgtgataattcaattttgcacatgttgaatttgaggaacctgcaggatggtaggtagataaaaagtgggataaggcttgtcccaatctgggtcttttgggattggtttgtgacctccttggggaacttgaagcaaaactggagatagcacattctgagtcatctactactgtgctgacctaggaagcaggttgtggggaggtggggggtgggagggatagaggtgagaggggtagggctgctgtccagaaagaatgcatgaagacaaccttccatcctgagtttttctggttctgacgggaatctctgtgtagcacctccattcctgagttcccagggacaatcaggcaaacattctctgaaccaaggagacccctgcatgatgggatggtcattctagctatctgtgtccagatccaagtgtctgagtctcagatgagctggtcctacacatgtgctatctgtgccctgcccaagctgtttccccctcctaggggatcagagccctctcaatctgctgcttccaggaatgagagccaatacacatttccttccctcctgacctctgctcttgaatgattattttaaaatctccccccatagacacactataaactgctctgtgatgttccttcactgtccaccatggctgagtcatgccagattataaatcccttaggacaggaccagcgtcaccaccgcaaggcacaaggcacaggactgactctttgtgaagggaaggaaagtaagtttctctagatctgttcaatgccacctccagggtcctgcagcagggctcctagctccctcagcccaaggacacctctccatgtgatgctacttccccaggttgctgggccaactggaggctactcatcctgagacctgtaaggccagacccaggctggacgaggctggtcagggcctggcagggcagtggggagcagcgtggaatggtccagagttcctggaggtggtcagggacaagacagctgggcctctctgctgtcatccctaggagcagtcagcaattacacagacacagctgctgtgtgattcaaagacacatatgcacgtagactcaaatacagagttgcttgaatgtgttcacaaatatacacacccggccgggcgcggtggctcacgtttgtaatcccagcccttttggaggccaaggcgggtggatcacaaggtcaagagatcgagaccatcctggccaaaatagtggtgcgcacctgtaatcccagctactctggaggctgaggcaggagaatcgcttgaactcaggaggcggaggttgcagtgagccgagattgagccactgcactccagagccagactctgtctcaaaaaaaaaaaaaagacaaaaaccccccacaaatatacacacccatgcaccaccacccctacccatacaccacacgcacacttaaattcagagggcaaatcccggttcctcccttcatagctatgtgtccccaagttacttaatctctttgtatcttaatttccttatttccgatctgtaaaaatgagaataatggtattcacctcaatgagttgttgtgaagattaaatgagataaaatggtaaagagcttacaacagtggcaacacatgcagagagacgcacatgttttcatactcatttcccaagccctgcccagtactgccactggcactggtggtgagcctggcagcagtacaaggttggagtcccttcatccctttgagccttggttttctcatctgtgaaatgggaataataatatctagccggcggggctgtttggaggaactaaagaggcccagcatggaaagctcctaacctaactctggcccacaaaagtctccctacgttttagctgtcactgtccctgtgaggaagaacagatccaagaacaggtgcagggatgggctgcaccacagcaaaatctggacaggcccgacccccatctcctcccaggctggagcggggccctgtaaggacagagcccaaggccactaggtgtcaggcctgttggagccaagtccggccagcagtctggggtggggctgggggcagggctggtcggatggccgtgggtggaaggaaaagaggaaaaccagctcagtggaaattgtcctgcggttggctcaggcgcccacgacactgtatttatagagagctccttgcagctcttaattcctcgcagtcgagttaaccctttctgggctgtggtgccagcatggtgtggaggaagaacccaagactggggttggacagcaggattccagccctgttctgccgccagtcgatgaccagtcagtcacctatcccctctcgcagaaaggaagattcggctcttggaagtgtgggaacggggtgggggatgggcagcgccctgctccgggagccgagggttttccccgccagggtcaggcctgggggcggggcggggcgggggcgggggccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgcc

SEQ ID NO: 183 - DNA, 1195 bp, Homo sapiens
  CpG Islans of CD276
tggggctgggggcagggctggtcggatggccgtgggtggaaggaaaagaggaaaaccagctcagtggaaattgtcctgcggttggctcaggcgcccacgacactgtatttatagagagctccttgcagctcttaattcctcgcagtcgagttaaccctttctgggctgtggtgccagcatggtgtggaggaagaacccaagactggggttggacagcaggattccagccctgttctgccgccagtcgatgaccagtcagtcacctatcccctctcgcagaaaggaagattcggctcttggaagtgtgggaacggggtgggggatgggcagcgccctgctccgggagccgagggttttccccgccagggtcaggcctgggggcggggcggggcgggggcgggggccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagc

SEQ ID NO: 184 - DNA, 5013 bp, Homo sapiens
  2nd Promoter of CD276
gctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgct

SEQ ID NO: 185 - DNA, 6992 bp, Homo sapiens
  CTCF- and Transcription Factor Binding Site of CD276
tctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcact

SEQ ID NO: 186 - DNA, 4693 bp, Homo sapiens
  1st Enhancer of CD276
tgggtgatgatgatgtgtcaaggtaggttcattgatggtaacaaatgtaccccataaattgattatgggggaggctgtacctgtgtgggaccagggggtatatgggaaatctctgtatcttctgctcaattttgctgtgaactaaaactgctctaaaaaataaaatctattttttaaaacaacaccacaacattttctatccatgtacttgtcaacttctggtcttttcatttagccacactcatgccacaagcagttattaagcaatattctaggtgcagaaatacagcagtggacaacaaagtcatgattcaaattctatggagggagatagacaataaatgcataaccaagtaatatataatattatcagagggtaaataagtgctaaggaaaaaaaatcaagcagagtaaagaagttggggatgaccaaggctggggatagtgggcaccactttatatagggtggtcagggaaggccttcctggaaaggtaacacttgaacagagacctggagaaagtagggaatgaactctgtggacatctggggaaacagtgtcccagtgagagggaagggcaagagcaaaggcccaaaggcaagcatgactggtgtatttaaggagcagtaaaggaagcgaacgcagagtagaggaagcaagtgggggagagatgagatcagaaggaaagcacagagccagatcatgtaggatcatatagaacaattgaaggatttaatttttaccctagagaattctgagcagaggaatgacttgatttgcttgcatttaaagaggtcactgtagctgctgtgtagaaagtaaactatagagagaagtggaaggaaagagactaatcagaaagccactgcaatacaggtaaatgaggatggcttggattagggtggtagcagtggagaccagaaaggtggttctggttctggatatatttcgaaggtaggagccagtaggattgttggtgtgggttttgcaagaaacagaaaaatcagctgggtatggtggctcatgcctgtaatgccagcactttgggaggccaaggcgggtggatcacctgaggtcaggagttcgagagcagcctggccaacctggtgaaaccccatctctactaaaatacaaaaaattagctgggcctggtggcaggtgcctgtagccccaggtactcaggaggctgaggcatgagaatcccttgagccctggaggcggaggttgcagtgagccgagattgctccactgcactccagtttgggctacagagtgagaccccatctcaaaaaaaaaaaaaaaaaaaaaaaaaaggaaaagaaaaaaagaaacagaaaaatcaaggatgaccgcaaggtttttggcctgagccaaaagaagaatgaagttgccatcgcctgagatggggaagactgcaggataaatggtttgttgtttgttttagtggcagtgggtaggcaggaggatgaaaatcatgagtttgattcaagacaagttagtgaagatgttgagtaggcagtcgggtatacagaattaaaagatacagtccaagctggaaacttgaattagagcgttctcagcacatagatagtattaaagccgtcagactggatgagatgaccgagggaatgggtctagacccagaagaaaagagtgtgagtactaagtcctggagttcctgtacattaaggggttggggagaggagaaggatccagcataggagactagaaggaacaaccagcaaggtgagaagaaaagcaagaactttctgttctagaggcagaaagtgtttcaagaaaggtagtgaatgatttggagacagtgaaaagattgatgatgcaggagaggagaatttctggcgtgatgtccttgagtaggcaagttgcgcaaaaggagggctgacctgaatggtagcacaaggagggaaggcagagggtgtggcccaggtgctcttttctctgctcccagacctgctcttcttgaggtggccttccccttctgccccctgcacttgacccatttcctggtgccagactctgcaagcagcactaccagggtaattagatcgatgtcttcccaagtgtgtgttgtcttagagaaggtcagacctgggcaggtccctgatgcctttcacttattgagttcttcccatccttcaaggtcagctataacccagctcctctgcgaacccttccctgacctccacagcctcagtccacacagctttcccctctccttccatcccatttccttcttcaagctgggcattgaggagcatccttggagacctaggacaggtgaggacaggagcccatttcagctgcatttccacttatcaccaggaggtggctcagagtagcaagtgcctatgtcaaccatgatggaaagaacttggaaaaggagtagggaagttggagactgttagttcctttctggctctgcaggccgcttgtccatggcgctagcctgcttcattagtcctgtctgctgcagggccgaggaggaaattctgatgctctcagtgagaaatggtggctcagggctgcagaggagctttaggaggactctgagaggaaaaggcccagaacggttaagctacctcctcccgccacatggttagtttgtggcagggatgagaggtgagtcctggtgtcctggttttcagcctgctgtactgtcaatgccccttcccgccagccagggtcaagcattcactccagagttcaagccttcattcagctatagcatcccaggtgggagtgagggagcatgagtgaggagcctggaggagaatgagccagagttcctgccctaagggagccctcaaagtgcctggggagatatgacatgtggcttgggccaagtggagaacactgtgggcagcacacatcagaacagaccaaggctgaagctggcacctgctccttggaggaggcttagggaagtaagtggattggtccagtttgagaggacaacctctgatagactccctcctcttaagctgggaggaactggactacatgaatatttatggaggggtggagggtgatggagacgggccacattttgacagcaatgctgaccctaaagaataatgaagggctggtcaaggaactactagggtgaggggagaaactccagctggagtcactcctcagaagccacacatctggctgcacatctccctgagtggacggcatcagtgctgctgctcaagttcctgtttggaaacccagagcccatccctgtttgcctgtgaaggtgccaggttcctgcagaaagtctgcttataaaggatttcttttgaagttatgtttgtgatggtctcatcaagaaaactgaggaaggaacaggagccacacatgtcatttagctgaaagtcctgttttaagaaaacaaacgcaaggttgtattcatgagcaactgctaaccacaataatggaagaagcagttaagctaataagatataataccccatacttcatgtagtaaccttgggagaggtaggccagtgggcaggaagccccatgtctggtggcagaagcagggtgggaaggaaactgcaagagaactgagccttggtcactgactgaggatgttgcgattcacacatcctgcttcgtggcctggattgtctcgaactgggttcttccctagcaccagtaacccaagtggagacctagcagcagccaagacatgttcccaagaagggtcactttcactgcaaaatgcctatctccaggagaagagggggagtggactgagagaagccagggagagagaaagggcagggatttgcagtcagttgtcctgcctcagggattagggttgacatgaagaactgcaggttaagagtgctccattaaggaagattagataaactgttctcaccactggggcagttaaaccttcccttgagtccctttggtaaggtgccctgaagatgcctaggcataatgtcacaaacccagctgaaaacgaataccacaaagagaccctgtgactctgaaaacagcaatatttgcacttaagattcagcacctggcttactcctgtagtcctagctactagggaggctgaggaaggaggatttcttgtgcccaggggtgaattcaaggctacagtgagctacaattgcactacggcactctagcctgagtgacagaacaagatcccgtctcttaaaaaataaaaataaaataaaaaaggattaaactcctggattgaaattcagatttctggattccatatggtttatccactatcttccttaagagggccatcaccactggcttgtgaggcagggccccttgttctccaagccaggggcactcgatcttattcatctagcaggaacccttagttgttctggtcagtgcctgcttctctgagcctgtcttggggcaagcctaggagcagggccaggacgagcatgaggtacctgcacctatgatgcaaaactgaaggaggtgctcactttcaggtcagcgcaagggtggagcctgttcaattatttgcatgtgagagctattagaaaaaaacaactcccaatgagatagaagagttcccctggtagcatggtgctgtttttagtttgttctgttgttttgttgttttgttttttaaactctgtacaaccctcctatttggaggacctgccaccttccttccgactcaccagcagcaggacaca

SEQ ID NO: 187 - DNA, 12795 bp, Homo sapiens
  2nd Enhancer of CD276
gggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctttttctctgtgaagtgtttggaagcagggtgggccccaggactcaaccagcaggattctctcctggatgttgcaggctggggtagggaagcctggccctccttatctcaccgtccttaaatcactggatccccaaggccatttggctccctccttggcttcagtttccctctgggtaaagtgaagttggttgtccagaaagccaggccctttggtcactgtatggggctcctcccactggaagcatcactcaatttctttgcctcagaaaactcaaacctaggcttgtttagggcctctactaatgaacccattttagagactgtgaagctgagacccagtaagaagctggcaccaggaaaagagttctgaatgctgtttctggctgactcaattggatgggcaccaggccagggatcagaggtccattcccaggacatagttctgccctatgaccctgagcaggacatttaccttctctgagccttggctttcttgtacaaaaaatagccacctatgcatagtggctcatgcctgtaatcccaacactttgggaggctgaggtgggaggatcgcttaaggccaggatttcaagactagcctgggcaacatagcaagaccctgtctctgcacagaaataaaaaattagcgaggtgcggtggcacccacctgtagtcctagttactcaggaggctgaggtgggaggatcgcttaaggccaggatttcaagactagcccgggcaacataacaagaccctgtctctgcacaaataaaaaattaactacaggcacacacctgtagtcctattactcaggaggctgaggtgggagaatcacttgatcttcagcccaggaggtcgaagttgccatgagctgtaattgtaccactgcattccagcctgggcaacagagcaagactctgtctctaaagaaaaaaaaaaaagaaaagaaaaataggactgaggttttaactaccttccattttgaaagactgagaggaggcgcacaggcttccagagagccagattcagggctatgggaacctgcctaggatactgcgttcgcttgcccctggatgacagtgtcctggcactgggacagcctggagctttgcagaccctgggcagcaggaggagcctgtgctgggggtgaggacacttgactttcaatcctggctctgctgctaacctgtgtccatgtccttcatacctctgagccttactttccttatccattagataggggtgacaagtcatctcccaaaaagtatgtggcattctttacaaactggaggctttgttataaagttgatggctctaggggtgagatcagtcatgttgcttgaggtcctgtcatcggtgctctgggtgggtattaggattgaaagacttatgcctttgccccttcaacccactgtgtgcccttgagcttgctgcttcaccacactgggcttcagtccctacctgtagagacagtaatagttcctgtttcaaagcactgttgagagggctggataaagcagtgggtgagaagacactgcaattaggccagatgcagtggctcacgcctgtaaacccagcattttgggaggctgaggcaggcagatcacctgaggtcaggagttcaagaccagcctggccaacatggtaaaaccctgtctccattaagaatacaaaaaaattagccgggtgtggtggcacgtgcctgtagtcccagctaatcagggggctgacacaggagaatcatttgagcccaggaggtggaagttgcagtgagctgagatcacgccactgcattccagcttgggtgacagagtgagactctatctcaaaaataaaaataaaaagacactgcaaaccattaggtgctgggcacatgtggggggctattctttccctccctgcagtcaggcccacgcgctgttgctccttaggtgattttgtagattgagcacagtgacttggaacaagctctctgaagcccagtttgttcatctgtaaaacaggcacaggaacccatgctttttctttgcgacagggctggataaggctcagacaggacactgtatcaagtgttctgggcacggacccagcaggtgtgggacttgcctggaggcttaggtgtaaagagagtggcaactaagtcctctggtgacaagtgccctggacagcagtatttttagctgcccttcctgggcaaagctccaactcctacattttaatggagaaataattctcacagtgcgacaagctatagcttgcaggtgtcacatccatattaaagaggggacagagcgaggttcatttgcctggctcaaggtgtgaccagaattcgcctccaggaccatttgtaaccagggcttgaagaccagtggatctgactactcaccacccagaaggaggagactgggaggaggggttaaaatggtgtggccagggcacctggatcatcctgcctcttctacttgtgtgtttggagcattctgcttacactcgcagaccctgggcagcaggagcctgggctgggggtcaggacacttgactttgaatcctggctctgctattagactggccaccttctagactgttgtatcagtcttacacatttacaaaaatatcataaacatcatgcaacccttttttctgtttttctttactcttttcccaagtcacttcttctagatagaagtgtccttgtcctctttaccttctatatcgatgtgtaacatacctctagtatttacaagatgctaatcctcagtgtatgactccatgaatttttacacaaatctctacccatgtaaccactacccagatcaagatatagaacagttcctggattccagaaagttccctagtgtccctacccaagcaacagccccgcccacttggctgctttcaccaattagttttacttattcttgaacttcatataaatggaatcctgcagtacatgctattttgtatctagcttcttgcaaagacctccctcgttctttttaaatggctacatagtatctcaaagtactgctgttctagcctatattttgctagttcctacagtttagacacaaataatgcaggcttgtgttcgagtttctacagtatggagccctagaagtgggatctctggatacattttaagtgttaccaattgtttcagctgcctttttagccagtccctgtggcagtaagaatgcaagtgaagaaaacttagggtggctggaaaaactgattctagacagggcagagatggtgcttggaattcacatccagttggtctctcagagacttcagagtggagcctgatttggtagtgtacagggcctgcagtcatcccttccacccgctctggaccaccttgcccttcagcatatgtcactgccgctgcctcagtttccaggagctatctgcgtccccgggaccccagtcctgggggagtgcgtctgcctcctagtggattatgtgggccgagcaccgtgttctgagtgtgtgtgtgccagggttgagccctgcacccgcagcaccataattgatggggggaggttctcagcatctttggggtttttctttaaaagaaggtctcactctgttgcccaggctggagtgcagtggtacggtcatagctcactgcagcctcgacctccagagctcgtgatctgcctgcctcagtctcctgagtagctgggactgcaggtgcctgccactacacctaattttatatatatatatatatatatatatatatatatatatatatatatatttttttttttttttttttttttttttttttttttgcagagacgggatcttgctatgtttcctgggctggtctcaaactcctgggttcaatcaatcctcctgccttggcctcccaaagtgctgggattacaggcaagagccactgtgcctggtcagcatcctgttggatgcaggtggctcaggttaggttaaatctcttgcacttgtgtcagagagtattcataacctttggcactgccagctccaggtaattatggtgacactacttcattactaatgaggcagctctttgttagcacagagaaacacctgggtctcatagaggaggcataacccagccctcagacagagggactgtgacctttgcctccagcctttctccagcatctgagcagcaaaatatcccctgcacctcagcttccttagctaatatgatttctccaccccagcgctctcctctggatgtgtttcatccgtgtcccttgcagattgaggctctggcatggatcacgatgcttcagctcatgatagatcacctctcacctcctgcatccagggcactatgttcctagtgatacagctccagatcccattagtccagcggttctcaaccctggctgcccattagaatcactttgggagttgtaaatggtgcctgggctccatccccagaagttctgatgcaattggttgagtttattgctaagtatttgatgtgcatatgccagtggctctagtctggcttataaattaatgtaaaataggattcagaagacagccctgagctgagacctttgagaccccacctcttagataagctagctattctcagtgatcaccatattggactgtgggttttttgtttttaattaagggaagcacacaaaatacaggagcaaggaaggttgagggaagtgataatctttagttcagaaaggagggggccctgttccctgtgttgtggggctggggaagagagcaggcatcctgagttcctgcattcagaccagacacataggctatgggagaatgatgaaggatggggtgccgctggtgatggctcaatcctttttagctctaggaaatggggggccctgcctactcctgatcatcccctcccccttctcctttcacggcctcccttttgcctctgtgtctctcccgtcacccccaggactccagatgtgcgcagccacgtggctgtttctgactccctcttccctccagcaccatgtcctccacggagggaaggaacatctgtcctgctccctgtagccgtcagtctacgtgcatgtgccaggctcagggaaataatagccttcgtgcttttcctgctccccgcccccccacctcccatctcacacatgcttcagaatcagggtatcctggggtctctaccacactgcagccctgtagtatccagagtgactgaagcacaggagctctcctctaccacccccaccctcctccttgcagctctctggcctctagttcttcctcagtctcaaaactcacctatctgaagtccacctgcctacctacctacccaccctaatttacaggccagcatgctccctgggtgctggtctacactctattctgtttccttcctgctcctcatgttgcaatatcctctcctaaaaagtccctgcagagtgtggcaccattgttggaggtggggaagagggactgatgtgtctgcagagcctgccagccactgactgacattttgccttatttgctaagataatttagtgtaatttgctaatgaatgaatgcacttcttgttcttatagcttttgtaattgcattgaaatccatgtgcttgctgacagtttcagcaaacgttccgggaactgaagctggccaggttacagagggctcagcctccttgggtgaccatgctgagggccttgatgacctgtgaggcatggccaggatgctgattttcttggtgtctctatctgtgctgcttttctcagcgtcctcccgtccactgcagccaggaggatctgggtcagcccaacaggagaatgtgctggcagccaggggttctggacctaggacatttttggaatgggctttgcagtgctagaagagagtgcattctgttctgtctgcaggatgggtgatgagggagtcagggggaagtataagggagaaggggacagagatgactggcgagtggcagaagttgcatgtttcatattcagtcgtgtttataagcatttgctccagctccccccatccttggatatgccctctctctcctccgcctgtgcagatcctagacacccccctcctatgtatccccccagatctctgcaactccgtgtttcatagctacgatgaagcacttgctcattcattgcactctgggaactcatctccccagagcagctctggctggcccccaagcccagagccgggcacagagcagctcctgtcctctggtctgctgcaagcaggaggtacccaaaccacattaattcaggtctctgaatggaagtaactaaggctgaagtttacttctacactatccatgaaaaaatgatttcccagcaaatgaacaatgtaaatgaggcagccaaatggtgcttcacctatttaaaggaataatctattttaaaaatcttttagaagcttttagttacccagaaacaattgatacggtaattgcaagccattttttaaatttacttattagagaagactccctaagctctgttcacccactcccatgctctgctaacccttagggagctgggtactaaatgctcgctgtccttgtaggccccatctgtaaaatggggtcaagagtagtaccttcccctccctagttgaccaaaatggacagagaatgcccaaaggacagagccttcacagggccacctcacctgcacttacacagtatgaatggacagatctgggcagatggcactggactcagccaggacaaaagagagctttgacctgagaccaatagggaggggctggatggtcagacaggatttgtgtggggaggatgggggtggaagcagaggcgatttctcattgctcagcccaagatggtagctgaaggagccccaggcacaaggagcagcagccatggccccctgagcaccagcaccgcagatccctggcctgcaaatcgattctgctttctgtttgatgggcttgttggcttcagcttggggaggaaaaacaagctctttcccaaggagaggagccgtgtcagaggtggctgtggtgcctccatccctgccgcacaccccatccccacccagccctgtgagagatgctgggtcagcgggcaggacaccattcttagcctctcccctggccctagccaggcctctgcctgcctggtggtgtggggcgaggcaggccaagatgcctgggttgaggggctcctgcgggcagttgtctggccctgtgcacctgctcaccgcggctgctcctggtccaatgtgtgtggccctggatggatgtgtgcatttggtggggtgagagagtaggtaagagtgaaaacaggaaagcaaagggcagcatccacaaacttggaaacatcagcctgctgtggaagggacgctcaagccccttgtccacagtattgctgagctctagaaggggaggaattgggagcagctgggagcaaagctcagaataggacccaggaggctctgcccccggctcagcgccatgtccacaagactctgtgatacacctctgtggggttcaatatgaggacaagaggatgggcatctgagcagccacttcctgcatgtggtgaggcagcccaacacagtgggcttttccgttttgcagcccccacagagccagcccctccaagggagcacgtttcattggcagcagtgctggcagtggcagctaagcccttatagggcaccactcctcccaacctcagcaacctcctctctcctcctgtggttttcctaataaacacctttaaaatatttatgaaggcagcttcaatgaagtaacacgacattgatttaaaatgattttcttctaataggtagcttgagcatgggctccatttcccaagctcctaagggcaggcccatcagggtgaacccccaggatgggcattcaaggctctccatcaatgagctgagcagtggggatcccttccctctctcagggcctccactggggggccaggtctggtgacaagtgtggtgtgacagtgtcatagggctcaggaactggactctggtagaaggggtctaggggatcaggcaggccaattagggctctggaagaacgcctgacatgggaagaagctgaaaactggaagtctccctagaaccatggatagcacctccaacctgtgcccctggggcactgagaagcccagaagctgggagctaggactcctcggtctctgtcccactttattgataggaatggagaaaggctgtactccagaaggaggtgatgagcgccatgggtttctagggaggaacctggactgggatgctgtggccactgaacagttggtagctgagtttagctgctccccagcagccctggctggaaaggacacaatggcaatgccttctgtgcacgtgtgggggtgggtcgggagcaagtcgggatctgcagttggccctcagatttgtctgtctggcctttgaaactccaagaagccaccacctaccctccttacacaaatccctgagctgccctctcttgacaggattgtactttgtccaatctcttcccggcacagagggggaaactgaggttcctccccatctaccagcctctccgcaggctagaaggaaaatcccatccatatctatctggcacgcagacagaaggccctgatggagaaattttgggaggaaggttctattctcaattctcaccccactcatccccagaaaagtctaacaagagctgttttcatcaccattgcctaaagcctgg

SEQ ID NO: 188 - DNA, 25940 bp, Homo sapiens
  Coding Sequence of the C10orf54 Gene
agtcgtagttccaccgtttacttgttttgacaagacacagacctttcagaacctctattgccctctgtgttaaatggcagcaataaaacctcccaggattttcagggaagggggtggatcaaacaagttacaacacatgtgaaagtgtgttggaaagcaccaagtattctaacagaaaaggccaagaaacagcatgcatgctgccacttccctctcccgtgcccaaggcagacatggctatctatctcggcactgtctcaccaagctatattgatcattcagaatccctctcaacacattccaggatagttagggtgacatagcctccatggggtgaagagaagcagcaatgcaaagcagggaatgcccagggaatgggccaggtggcctgtgccgtctatgggctgggcctcatgctcagctgggctgtggctgggcttcaagaggcctttgttcccagcatcctggttagcaaccccagttcctctttcgtgcattgtggttccctgagaaaacgttaacccagcccccagcacagtcaggccagccctggggaaggcctcattcatgaggcaggaccccaggggccaagttggtgctcggtggtggcaggacccctgcagccccctgtcccactgcacactcccaagtccaccccgcgaggagcaccccctgaaaaaggccatgtatcagcccctctgccctgggccactgcatgtagtgggagctctggtcaggcagaagtcttttgaaaagcaggtcctggggctcctgcacctccaccccagcgcccatcgccacggactcccccaggcagggccagcctgcccaccagcagtcaccagtggcctccatggtgtgtttttagggagtgctgagcagtccccgctgtgtcagcaaaaccctccaaatggtgctttcaattccattccttcagcctctccctgggagggaataaaggcaggaagtctctattaaactgtgaatgtcaggagataggtaagatggcccctaattcctgattgatctcctaacaatgaattagttcttaaaagcatggatttccctctcagggcctcagactgtgccacgaatccagcgctccaggagcctcctgccccagcccctagtgctcctcccgccccctggaggcgccatgttctcgcacccagctctcccatgcaccccagcccacagccaccagggctggcatcagaggcactaccatcccgggcaactcagagggcggctccagcagcctgcccctccccagcagcagcagggagggacgtccctagtgcgttgtaggcagggcctgtggccatggatgaagatggaactgggagctcagagtaaatttcgctgaaaacaggaaaccacgaagcccagatgcgttcagttgtaaaagggtccagagaagagagggcagggccgcaccagaggaagctgaggaggaagtgcggtggctgttctgctgcgggccgcctccctctccacacagcagcagccaggcctggggtctggcagccaaattcttagaagttgtctctgcctcaaggtcagcagctgagggctggggccaggccagcctccccagagggcagggcatgctcttcctgagttgggagaaccggaatctgggctgtgggcttgtccttcgactccaggaacagcaggtgtcctgtccccactcctgccatgcaggcccccatgaattgtgaaaaacataccctctttccttctttctttctttttaaaatttgttttgaggcaaagttttgctccgtccccaggctggagtgtagtggctcgaacacagctcacagcagccttgaacacctgggcttaagcggtccttccacctcagccctgcaaagtgctgggaggacaggtgtgtgccaccatggccagccagcaccctcttcctatggcagctggcatcaagcattgtggtgaccagagggaacaaaagaagggacccccctctgcctagggacaagggagaagccggggtttgggcatattctggccactcgaggtgtcagccccatctccgggcctatgtttaccctctcctcaaagcccctggcccagcccaggcagagcaggaggccctcagtggaccattcctttgggcctaactggggggcttagaagcagggccatgtgtccaggtggggttccctggctgtagccacaggcccagggctcactgctgccaggcagcctagaggtgctccccttttccatccccccaaccccccaagcaattgggcgaacatcttcccgcctagccccaaatcctggctttcagcacccaggcccagctcagcagagccagtgtaggctgctaggagacaaatgcccaggctggactatgctctccacagtacctggggcccccatcctgctaaacgctacagggggtctgcccagccccacctcacctgtccccatgctcaggcactgccttccctgttttacccccagagtgtacagagatgccccctactctcctcccctgctttaaaatccttcaatcacaattccacagaggactcaccttgcctatgtgtataaaaacaaagccagggcatgcccacaagcaggagatgggaacatcacccgcacctggccgaatggctctgaagcgaagactccaccaggcccagattgtatggagtggaaggtgggggtgggggaggagcagcagagtgcagatttaaactggctcttacaatccatctccagggtttgcacctgtttccccatgtagtttttaatagcatcccgcttcatactcagaagtgtcccagggtggacaagacattgtgtggcacccttgcaatggcccgcgctgagcagtgggagtaggggatggggagggcggggggcaggtgcccctctccactcaccttcccagaaggccccacccacctccctcagcaccatctccagtgggtggggcaacatctgtcctggcctcagattgcccaagacaccatttgctcacggaggccaccatgccccaatatgtacttcccgtttcgggaccaccaagctctggggactggaatgcaggcagtggaagccccagattgacttaacctgttgacagatcttcagagaaactgctggtaggaggcagctggggaaggtggcgatggccagtgggcaggcaggcctggccccagagccactgtggtacaaagaggaagtctgacagaagagcagcctcgggcaaaacgggggagccaaggcggccacgggggagaagtctctccaccgtgccctgtgtctggtgcctgggagggtggcccagtgtccatcttgtcccactgatgctgccacatcccaaggctcatgtctcagaacgagagctgctgaagggctggacgttctgagacttcttaagatgtaagtcatttggcatctgtagctggtgaatttcaggtctctaggggagaatctcagcaccccaaaatccttggaacaggggctgagccgtccagcatccccatgtagcatccagaggggttgaggggctgggcttctgggatgtcacagtatctgagcccagagcaggagggagggaaccagggccgaggccaaggaggccactcacagagccagccctggctcaaatgcacctgccccagacccagccacaacagcccactgtcccccagctgggctagatgacctcaaagtttggagagtcagggacagggtctgcaagaaaaggagaagcaaagtgaacggggcccctctgcccctcaccctcaaccccaccccgtgaggccgtggaactcttcagggaggtgaatgggggcccctctgtccctcaccctcaaccccaccccgtgaggccgtggaactcttcagggaggtgaatgggggcccctctgtccctcaccctcaaccccaccccgtgaggccgtggaactcttcagggaggtgaatgggggcccctctgtccctcaccctcaaccccaccccgtgaggccgtggaactcttcagggagggcagggagtgaggccgatgccctgcaggccatgaggtcatgaccttacaggtcatcgtgctgtgaaggtcaggaaacacttacccagggatgggaagaagacgtctccggggcctggaggagacaggggggtgctgggctccgaaagcagatgccgcccagactcagaaggctgccgctgggccacataggacagggggtgcctgactttggcctcgggtatcccctgggcaggtggtgaggcttcaaagccggggttttcaatcccttgaatgttgctgccacagaaccagaatggaaggtcatctgtgctgtccggagcgtgaactctgccctccctgcccccagtttttctctcctccctttctctcacctacatccccatccccaagcctcagcagcatctccaagcaagaaggcaggagccaggcccacagagcaaaggccatgggctgcacctgcccacctgtcctgagctgagggcatcagggcccaccagaacagaccccagctcctccctgtggtctgaccatcaaccccgggcacagccaggaagccaaaaatcacagacacttctagaacttcagcctcaggaatttggggacaagtttctctttggtcaatagagttgatggcattaggatcgaacatccccaaagcctgtcttgagctgaggggaggggttctcttctcttcccagttgggagtgggataacttctgaagacccctgcaactcttagattctagatgagttgcaagcaggacttccttcaacctgtcttgaagatcatccctttcaaacacctagaggagctttgtgtttggtgttgcaggtaccggggcaggaacttgggttccctgaacacaccctccaggccaggctgcatggcagcttcctgcccagagcacaccaatacacagtccccatcccctctgcccctagacccagcccactgcaccactctgggacccctcagcctctgcccttgtggcctgcagcggcctaacagctttctccttggagttctctgcgggcaggaggcacagctcaagggctgtggctggggctgggcccgctggcctcctttgcatgtctcactgtctgccccagacagtgcttcctccctgtccccatcctggcccaggctgaccactgagacccgaaggtgggtgcatgacacatctgagcagaatcagagctcagcctgctgagtcggggtggcaggagaacagccaatctgcacagatgtgcaggcttcagcagcagatggcagaggctcttctgaccagctgctctaggcagctaaacagggcccctactgcacagaagtatctcttcctggatagccggcccaggaagttttctcaagaaggtctccatgggccttacctgtccatccgcaccagctcctgggcacctagggacagacagacagagaagctggtcatggaagggaaggcttccccatacaacatccctgcccctgctggcagatgccctgcagggaacaggagcgagcccaggagggccctgcacagctccggactccatttcttttcacatgggtgctgtccagcaagcgatctgcgtgtctgtccagcagatggggcctccatgaggggcccattttgacgactgataaatgaaactctatctgcattttccaggagtgtaagaacgctatctgccatcaggagaccaaaggcagccagcgctttctcctatggcttgacttacacagtgtcagaccttcaggatttaagtatcgagcaaaggtcaactcttgaatttgctaactggtgtctcttgtttgaacatttgccaggttctggtctttagccatgacttactgggtgggagtgtttaaggtcagttcctaattagagggctcctggtcctctctgtcctatcccctacattgcctaatagggtggcattctaggggacatctctcagggaaaccttacaaggtgcaagtccccgatcacttcccagccacttcactcactttctgcttctcatccaagttgctgccgcttgcctcagccttgggacaccccaccccccaaactggccaccaattagatgcagtgaccccaacttccctctttcatgcagcaccccatgtcctcccacagatgcttctcgttttaaggagatttactgctgattacgatggggaaacagatggtgggggaggggcacaacaacagaacaaacacagggaagttacccaaaagttcctgaaatctattcaaaccatggctattgcttacagccgactcatgggtcaggcttcgtgcaggtgcacacgggtattccctcatctcatcctctgtgccaccctttggggtgagggttgttggtcccattttagagctggggaaactgaggctcagtccaaagcaggatggaaatccacacctgttggcctctccagcaaactgccgtcctcaaggctcccagccctttccttttctttttttcctgagagtgcctcattcctgagcaggctctctgggccagccttccaccagggagggcacagcaacacctgctccccctgccctgctgcccagcgttgctcttctgttccaagccctttacctgcccccacccacccccagccatgggtattcctgcaggtaggttgtggtgtgttctaggagaggaataggggagttctgaaagcaagggtgaggtggccacagcccccgagtgacccactatggggcttcacgtgggggcccccgggaatgaggggagggagggatgacaagttgttaagggccggccacaggaaataagttgcgagccaaaagccacctggcaccagagcaatcctttctcagttacctctgtagccaggcagacgggaagaggccagggaggggaggcaagggtaaaaaactccctagccccttcttggaggactcagactaaccaagactcaagggcagggtcaggaactaggcaaggggcactgtcacctggccagggtgggaggtgaaagatgtttgtgcccatgacttaaagcccagccccaccacttatttgctgtgtggttccttaggcaagttacttaacccctctgtgcctccgtttgcccatcagtaaaatggggacaatggtaggaccaaattcttggacttgcaatgaggagtaagtgagagcatttttattatatggtggacttctattccctggaaagagcatgcgttgaaagctctgagattgagtcctagctctgccacttactaagttacgtaacattcagtcagttatgtaaccccactgatcttagccttctcatctggaaaaagaaagggttgagctaagttgtctgtaagaccccttccacttctgatattccaaagatcattttttgtcccaacaattgctactaattacaaaacaagcacgcccataccttaaacaggtcccccaaggatctctgagtggcagcaacttgcttttataaagcaacttgagctactgcatatgatcattcattcagaagacatgtattgagtgccgagccagcactgcctgggagccaaaggggctggtgggcacttggcccccggaaatggcatgcctcctttctctcggccatttcgcccagctcctggcgggaagtgcagctgctcccaactctcaaatgaaaaggaattgtgcctgcatcgtgcctttgcgaatcccaggggctgaactgggggctggagcaggtcactcgcaccgtccacccaccccaggcagggaggaatactcacggcggttggaggctgcctgcctttgcttgtagaccaggagcaggatgagggggaggcagaggattcctacgatgcaggcacccgtagccagggctgcagccgtgatgtctgaaagggcagagaggtagccaaggtgaagccccattcccattgctcctcctgagcataaactgaggctcagagagggaaggccaggaagcaggagacccgcctttccccagagtcccacagctagacccccagcaacctacagaggcatggaagataaggcggttctcctttcaaagagagccctgtgcctgccgccctatgcccctggagcactcagaaacaagacctgtcacctacagctcaggcagctccaggcaagagagggaacagagtcctcatcccagcccacaaggtacagctggaacacccttggctacaggttgttctctgaaaagggagagcagggccttcgcagaccccatgccacagagctcaaggtcaaaagaagcctaagtgatgaaagttttgaaaatagacagtggtgacggttgcacattgtgaatgtaattaatgccaccaaactgtaggcttaaaatggttgaaatggcaaattttacattatatatgttttatcataatagataaaaagccccaactcatcccagagactccttagctctgggatggggcctctagaaccccttgatctcaccacacaagtcacaggagaaacacccggggtgagaactagaaaaacgtgaatccttgtacaatgtttttcaattttaaacttattaaactaccaaaaaaagtacaagtttaaaaaatattcgaatctcctcctccccttgtaccaagaccccctctgaagagatcatccctgtgtgccggtttttgtgttatggtcctagttatattccctgcaaatacagcagacgcagcatcatatgacaatgcttttcccactgagcacagcttggacatctctctgtctcccctgcctcattctgcttagagttttatcacatggctcccactaaatttattgaagcagtcccctgttggtagacatgttgtttccattttcagcataactaataatgtagcaatgaacttgtgcacgcagcctggctcactcagcaaggaaatctgtagtaaattcctagcggtcaaagtgctgagccaaagagtatgtgcattttcttttaggctattgctaaattgccctccaaaaaggtgtacacgaagcttcgctgtcccaacagcatgaggaggtttgatttatttcagggcatctgctgactgcaggagtttagctgggaacagacgtgccctcagaaccacaaccaacataaacgcatttccttcccaattttagcctttcccagggccaaaagatgggctgggataccttgtcacagtgtcaacttcgccccaaagagctctgagaggtaaatggctgtggtctaaatgttgcctttccgctatttgtttgggaataaaggctgtttttgttttgctctacaatccgacagcgtaaacaagctttcaggaggtttgttcatactgcaaatgagaacaaactgttttcagtcactttagaagtacccactggtacaggaacagttgctatgctaattacaaagcaagttccgctccacattacagcaggttccctgcagatcttagcaaggctgcattttgacgtggaatattgaaagtaaagacattctataacccagacacctcagtatttcaaaacccccatcaaaggaccttattgtgggcaatatttgagaagccagttgcaaagcactctcttctagtgatcaaagcaggtctcctctggacggctagtaagcaacattttgtgagctttgccaggtgctcattgatacctgttccctatctgcctttggagggtgagcttggccagatatccctgcctaacttctatccccaggtagagatttcccctatgtggaccctctatcagatcaggacttaatttcactttgagagcctgaggcttccttacgatctgggctgagttgaggctggggcagaggggcgcagaggtttggggacaagtctgtggatccagctgctttctgaagccgtaggcatctctgcagagctcagcctcgccacagttccccaccccttcccccaagcgtggccagtgcctgggctggcactcacaggggaaggcaggcatactcactcaccatccagagccaggcttatcctgggaaggtgatcaggcgctggcagaggtagctgccgacaccgcactaaggagtgtgccaggccctgacacagcagggtgggatgggaggggcctggcctgctcaggcggcctttgtccagggcctgcctggtagcccacggggatatatggaggagggagttcggctgctgagggttgggctgcctggtttcccagggaggaagctgggtgaaagcagacagcacattctgctgcgctggggggtgggaagaagttcaaagggagatgagctgcctagaccccttctctgagctcactgagaaaccacagcccctcagcaatgcaggagctccttgggcaccaacttctctagtctcattcccctacctcaggttaacttgtactttcatgttatttcatagtcaagctacactcttacttcccaaggataacattaagaggctggcactggggctgggcatagtggctcaatcctgtaatcccagcactttggggagccaaggcgggtagatcacttgagcccaggagttcgagaccagcctgaccaacatggctctgaccaaaatgcatgttctaattttgctcttggcctgtttgttggtttgaaaaaagggtagctgagtaaaaagtcactgtagcctttgagttgggttttgttgggtccgtggtttagctgatccccattccggcttaggtcctcgtgcatgtcctcctggatgcctttgtatctccagggcctagcaggggctggtccccactggatgtctgacacatacagggtatagaggggtgtggaagccaagacctcttctcagaagagggaggtgcccttgcattttgtctccaagctgctgggtattctcacccaacctctcagcgccaggcacccttagggcagtgccctcttaccctgtagggcacctctctggcaagcaccggggggctaactgctacccactgcactgccccaagctgggaagaaggtgagtatgcagagctaagcaggcctgcagccagatcccagctatgctaccctgggctatgtgagcttgggcaagttagcatacatctctaggcctctctttccatggatacagagaagatggtgatgcctacttcatagagttcttataagaattccctgaggctaggcatggtggctcacacctgtaatcccagcactttggaggtcaaggtgggaagatcaattgagcccaggagttcaagaccagcctgggcaacatagcgagagtgcatctctaccaaaagtgatttttttgattttttgggacagagtctcgctctgtcacccaggctggagtgcagtggtgtgatctcggctcactgcaacttctgcctcccaggttcaagcagctctcatgtctcagcctcccgagtagctgggattacagatgcctgccaccatgccaggcaaattttgggttgttttttttttgagatggagtcttgctctatcagcaggctggagtgcagtggcgcgatctcggctcactgtaacctctgactcccgggttcaagcgattctcttgcctcagcctcttgagtagctgggactacaggcgtgcaccaccatgcctggctaatttttgtgtttttagtagagatggggtttcaccctgttggccaggctggtctcgaactcctggcctcaagcgatctgcctgccttgacctcctaaagtgctgggattacaggcgtgagccaccgcacctaaccccaaaaataatttttaaaaattcaccagacatggtgatgcgtgcctgtagtcccagctacttgggagaatgaagcaggaagatcacttgcatctggaagtttgaggcttcagtgagctgtgattgcaccactgcattccagcctgagtgacagagagagagtctttctcaaaaaaaaaaaaaattcctgaggccaggcgtggtgactcacacctgtaatcccagcactttgggaggccgaggcagttagatcatttgtcagtagtttgagaccagcctggccaacatggtgaaaccccagctccactaaaaatacaaaaattagccaggcattgtggtgcacgcctgtaatctcatcctagctactcgggaggctgaggcagaagaatcgcttgaatccgggaggcggaggttgcagtgagcccagatcgcgccactgcactccagcctgggtaacagagtgaaaccgtgtttcagaaaatatacacacacacacacacacacacacacatatacacacacacacacatatatatacacacacacacatatacacacacacatatatacacacacacatatatacacacacacatatatacacacacacatatatatacacacacatatatatacacacacacatatatatacacacacacatacatatatatacacacacacatatatacacacacacacatatatacacacacacatatatatacacacacacatatatatacacacacatatacacacacacatacatacatatatgtgtgtatatatatgtatatacatatatatgtgtgtatatatatgtatatacatatatatgtgtgtatatatatgtatatacatatatatgtgtgtatatatgtgtatatatatgtatatacatatatatgtatgtatatatatgtatatacatatatatgtatgtatatatgtgtatatatatgtatatacacacacatatatatatatatatatccctgagataataatacttaaaaagacttagtccagtgcccagcacagtgggaactcaggaaaggtagttctgttccccttcctgaacctcttcctcctccctcccctgcaacagagaacatctgaagaacatagaaacacagaacacagaaatctgaagtagtttaattctaggccaagaggacccccagccttcccaagccatagggggctggtgggcagggcggcacttagctgcctggggcacccagtacctgtcatgaggcacttgccctggccaaaggtcactgccaaggcacagccactccagagagtcaagaggagcagagactccagagcagatggaaggagagtgggcttctggggattgcaccaaggaggaagcagaagggatgtgcagcagcagaaaaggaggaggaccggggggttctgagggcttggggtgatgaggccagagttccaaacagggtctgggtgcaggatgaggacagaagaaaacagagaacccaaaaggggcaagaggttggtcccttactttcactatcctgggaggaggatgggtacaccacacagttggatggtgcatctttgcctgtgggaacaaacagaagggccattaggtgggtgtcaggcccaggaggccagggaggcttgtccaggccagtgtccccctcctgccccaggttctcacgctagtgcctactcggcagtgttggcccagtggcagcctgcacacgtgtgcacccacacacaccctggcatgttctcaccctgcccattttcatgccactcccaggggcatgtgaatacccgctggtgcccacacctctatccgaaccatgggcccttgcactctcacctgaacagacagacacacacacgcatatattctccaacagccattcagccatccactgagtcatgccccagggcaccaatcagtcccactgatgcctatacccacagcagccatgatgtcatcatgagcagtcacactcccagcccaggtacctacagcctcacacattaaaaagtctcactgtcacaaatggagccaggtacaccctccctctccatcactccagctaactacaaacccacactccacacacccttgaccaccccatctcacccacacactccctggagtgccagtgttacccatgcagcctcacactctgcccagcacagtgtcatgaatggtcacaccatcagacaggcagccctccacacacgccaggctgtcacgtgcaggatgccctcacctgtctgcacctgcagctccatggcaccatggaccctgtgctccgagtggtggtgcctgatctccaccaccaggcagcagtagaggccgctatccagcagggtcaggttgcgcatggtgatggagaagttgccatggtggtcggaggccgactccagcccgtggcgctgagccaggtcgtggctggtgttggcagcctggtggcctccatggtgcaggtgaaggtcctggaacgtgaggttgcggatgggccggcgctctgagcaggtctgcacctcgcccctcgagctgcggtaccacgtcttgtagaaggtcacatcgtgccctttgtccacagggcccaagagcctgcaggtgagggtgacgttctgcccctcgggacagacatacagggaatacggcgtggcgaccttgaaggctgccaccggacctgctcagagagaggagagccctgtcacctgactgatccagtgctactcctggcaaccccagagcggggaagaaccttagcctctgctacttcccagccacaggccaggggcatgtcagctgacctccctaagactgccttctgcatttgttcacaaaccccactccatcctaggctgttgtagggggagtcacagaagcttccccaactaggggtgctcctggatgctggacagggcagggagagacttggagggcagtgatgcagtcgggtgtgtccctcttcccagtagagtatatgcaaaacctgttgggtgggaggcaggttggggagcaggaaggctgtttcgaacagcagctccttgtccttggccgctctgtaggggccatcaacacctctgccccttcctactcctaggactgaacatgccttcccatccttgccagggagcactaagagagcacctgcgtgtgcaaggcctgggccaggtgctgcatctcacctgcatgctgaatgcatggcctccccttgagcagacgaggcctgcattcccgacagcagaaccccatggcaaaggcaatccaatgccagccctcagggcacttggaggagggaggaaacagccttctggggacagtcagggacttcctgaaggagggagagtctttggacttggtgcatagataggatttcagccagtagaaagggtgtcctaggcaagatagtgtgaaaatgggaaaacccagtgtctgagggaccgggacagagagtatatgaaaggtcatctcatccatgcacgtccttccagccaaacttagaaaactgtctagttctgtttggtttttttcaccaagcaaatgaagcaattccctggtccactttgccttatcccaatcctccagcatttaattgggttgaccctcaaaaccatgagcttttgaaaacagaatattggatagaggccgcgtttctatctaactgtatgagcctcagtttcctcctctgtgcagtgagaaaactattggctacaatgcagggttgcaaaaggactagatgagggaaagatgagaacacaagatgtgagctctaatgccctctgcagacatctgagggatagctataattattatgcgttggtgttatttttatttatttatttgtttttgagacggagtctccctctgttgcccaggctgaccttgaactcctggcttcaagcaattctcctgccttggcctctcaaagtcttgggattacaagtgtgacccactacgcccggccagtggtatttttattttaaatggcatgtcaggctgttgtgggtctagcagagagggaaggagggttagaactatgtacagaatccaaactgatacatccttttcattgccccagccaggggcattgcccagaaccaatataatgccacatcctccttcagatgccccttccctgcccttagagcccaggaccctcggcggcaggctgggacccactggaagagctgaaagccttgcccagccaggagggaggcagcctggtggggcttctggagctggccagcctgtactggaccagtagctgtgagccacttagacgctgagccccgactcctcactcacagatgtttttcccagaaatgaaaacatctccctggcagagttgaggcaacggttagtaataattcacatgaagtgttctgtaagtgccatgcgagtagtcggcgcttggtacttgggagctagacaggtctctaattcattcagcaagtcaagaagtgcctcctaggagtgagaagcacagtgggatggagaagccagctttaaagtctttcctgctaaggtgtgaatgactgataacaacttgtgatccgatcctggggcgcttgtgtttaaaggagagtctccaaaggcaccaaagccccaaacggcatgtctgcaagagtggagttttaggcagagagccaagtctgggagccccagatttttggagtcattgtcagggtgagcagagatttcagaacttctttggcaagatacaggtctccttttcaggcagaaacacagagacccagaaagggaaagtggttggactgaagttccaaagttccagagggtatgatctcaaagcctggagcatgggggacttcaggtaacgcaggatctaggcagaaccgtaataagaagacacagcatgtgttgtgcactacgctaagggtttcatgggcatatctaacaatgccataaggtattgtttttattcccattgcactgatgaagaaactaaggcacagagaacttacgtaactcactgatgatcacacagcaagcaagtgctagagctagaattaaactcagacacatagacactatactgatgaaaaaaaaggccagaaactgggagcccacaggccacatccagccttcacacatatttcattggatcctcaaaatctttttaattttcttgagatggcaacatttaaaaaccaggaatttgacatgaaaattctgacttccagctctccttagaaaatcagaagataatgctaaaccagctttcccacagggcaactgtcagctggggctcagtagcagcttttggggggcaccggcactccagttcgccagagtccgtccgtactactccctaataattccacctggcctgcttcactctctcaccgtggtttcttggtcctgtggacatttgagtttgtgatgaatgagtgtggcttcttgggctagctggcatgggactctactgcccaaacccattatgctacaaatctgacccacagactcaagagaggagatgatccacccagggtccccagggaaagcctggcagtgcagggactagccaactctcctctgctaacccactgcccttacccctgcagcaggctcagtggaaaaggagccccaggaagcttggctgtgcccctggttttgtccgtgctggcctggacttccccttcacacctgagtggggtgggtgtagctgcaaaactatggctctgccgggaaacagaagtgaggaggacctagggaaagggctctcccacgtactcccaggaagaaacaaaacctgccccaagggggccctgtgctgcccccttccccagcaggccatgtggcaggtcccaccagcacctctcccagcttctgcccctttctccctttgcctgacatcacctcctaccccagagccaccccagggctgggagctgaattcagctccagcttcagctacggtagtatttaccaccagcacacataccttgggggctggccaaagggctggctcagcagacacggggctgcaggccagaggagggtatggcagggcaggcagagtagagctggcagccaaagcaagatgcgcaaagctgagctgggtggggttgggggccctcaagtggacagaggtgtggacaagtggggctagcgtggttgttggcctgagtgtccctgtgaacaaggtggggcagggcaccaggctgggagccctcagggtctaagcaatggggttaatgaccccaggattgtacccatagcacccgcagcagtagggaagggatgttctcccctggaggcaacttccttgagatgcacggcgggtgggtgcatcagagagaaagcagagttcagggagtacgggagagggggcattgctcaatcccccacacctccccacccctcacacactggccacccatcccacaggtcccaaaggagttgttccccttttagaaaaaagctgtcttaggattcaagtttggggagcaggggaggatgttcagttttcaagcaagagggccagacaggagagggtccaggacaagccagagggacaggacaaaccaagggtccacaggggtttgtcctggggagggagggaaggccagaaaacaccccatttactgtgtctgagactccagctgggacaaggcccacagcagcctgtcgttaggaggacactcgaaggcatggcatgggggagaggggcagcgcacagcacgcagaggggcctgcacgtgccccgcggactccacatctgtgcacatgcctgtgtgttgtcagggaagctgtgcagcccggctaaaattacaattctttggcgagaggatgttgcttattgtcaggagcagatccttttggacacctgggtcattgtcggagaccgggaaaagtgggtggggaggaaagcccctggctccagggtggccaaaagcatgtgggacaggaaaatgacccggggcctgggcctgagcatgtgccaggcgggaaccgtccagttgccgtgctgctgtcaagacccaggccccccgcccgccacccgccacctgccaccaggtaaggaggcagggccacctagaggaagagtgccgtgaacctgggaaagcctgagtctcaggagtaaaactctcgcttggattgcaacgtcctggggcctcagtgtccacttagttgtgccctcattgtgtgcccttgggcagatcccacccttctctgagcctccgtttcttcatcttaacctgagggctgccagctctaaaatcctgtgggcaggagggaagagctgtcttatgaccatgtattatgtgctaggctcttgctgagcatcttatacctgtcacatttagttctcataacacccccaacatgggtggtatcatccctattttaaagatgaggaaacagactcagagaagtgacttgcccaaggccacacagtgctgtgtgactgagctgagattcacaccttggacaggccagcactgcagacaggaagagccacccacctctccagaaccctccagtgggcaggcggggctgatgcctcatccttcagctatttagaaaaaatgaactgaccgtgcattgacctccacgccctccgtgcaacattcctgctctgcctcagacccaagctgaaaacatcattctttcattccacaaatatttaccaaggtcctaacatgggccaggcccaggcagggaggctgtggggatgcagagttccatcaggggcatctgctcagaacttgggcctggacctgtgcctgagatttctagctgtggcaccctcagatgtttctgtcccagtacaagggaaaggagctcttgttggcatcttctcagaatgccagtttttgtgaccttcacctctctccacccagcaggccccgggtgacccctgtgagtgtgcacgggatgggtgtgtgtgggtgtggacaggcctgtgtatttttcatgacagggcgtgagcttagcccacagtcgccaaggcaacgccctagcctttggaggtgggacccaagcttggttagtcgggcctaggaagccccacccaaacagctgaactctgaccagctgctagaggttgtcaagtaaacagttattaattgcctgctgtggctggccctgcactagatgcaaaaggtcccgtccttggtctcacaggacatcccaaagagaatgggacctggttccagctccccgccaggccccatcccccaggatggtccacaggctggggctggggctgtaggaaaagactatgttctgtctttatcaagatgcagagggaaacagaggcatggatcaatcaggactggggctgccaaggctaagaaaggaagcgtcacaaggcataggctcagggcctgaagccagcaagtctgccctggggctttctggccagtgaggacaaagggcatctcagatgtgtttattgatacctgcccccgcaggaagtgtccattcacatcagaccaagggggctgggaaggggaagccaggctctattgaaggaagcggcacttccagcaccttgggaaagcctccgtgcatccggggctggagctggaggctagcatgcctccccagggagggcctaggcagctggccagaggtcccggcccgtggatgcttctgtggatgaacccctcccagactccccaggcccttttggaggaggactgtgtgcagctcaggctcccggctccagccagccaccctcacgcttctatgctgtgaagacgtcctcagggtccagctcaagtctttttgccccctactactctgtgccaggcatcattctaagtgcttgtttgtttggttggctttgttgctgttgttgttgttgttgttgtttgagatggagtctcgctctgttgcccaggctggagttcagtggtgcaatctcagctcactgcaacctccgcctcccaggttgaagcaactctcctgcctcagcctcccgagtagctgggactacaggcacccgccaccacgcctggctaatttttgtatttttagtagagacggggtttcaccacgttggccaggctggtcttgaactcctgacctcatgtgatccacccgcctcgtcctccccaagtgctgggattacaggagtgagccactgtgcctggccgtttggttggttttctttagtgagctagggtcttgctcttcactcaggctggaatgcagtgacaatgagatcatagcccactgtaacctcgaactcatgggctcaagttatcctcccacccctgcctcccaactaggactacagacacatgccactatgcccagctaatttttaaatttttcatagtgatggggtctcgttatgttgtccaggctggtcccctggcttgaaactcctggcttcaagagatcctcccacctcagcctcccaaagtgctgggattacaggcatgagccactgtgctcggcctcattctaaacacttttacatagattagtttatgtaatccttccaccctatgaggtaggtactagtatcatctccattttacagatgagaaaacggaagcacagagagattagtatcttgcccacagcctcacaactaataagtgatggtgtcaggatctgaacccaggtagtcagcctctggaggtctggtgccatctgactactctctagagaatagaggtagctggggactgactggaggccccacctccttcttgaagacggacaaatgtcatgaccaatgaaagcccagcttgcctggccacgtctaccacatagttttacttttggttttacattaaataacattgaatcatatatagaagaggttattccctttacaattatttcagtcctgattacatcaaagagaaagtctcagtttgatgctaatatgtctctaaaacatttgctaatctccttttctttttaaattttattttattttaattttttgcaagggaaagcagcagttttcagactccgagccttcccaggctaaagtttccaactagaattcaatacccttatatggttttcctgttacgttcttttatggttttgttctatttatgacaagtgatactggctttccactaatgacagcgataaaaagtttccttttaaagatctacatactcaaataaaagaatgagtagatttaaagaaaaaaataagtaaatattatgaaaggcagacactgcagagatcacaaaggtgataagcaaatgactgaagctagggaaacaccatcatggaattaaccttcagaggagggtggtcagcctcactgagaccacgtcacccaacctgtccattgcacagacaaaggggaagtgtgtgtttgtgttcccatgatgagtgaacagcagaggcagggtttgaccccaggtccccatgggaaataagatcctacgcagaaaggctaaaggaatgggcttgcttggcttggtaagtagcagagcaacctcattattggattactgatgagaaagatggtggccactgtctttgtctttggtgatggccagccaaagtgaatggaccgaatgtaaaaagatcagatgtaagaaagatccaccaagataagcaaacccagggccaggcttgccttcaagttgcaatgtccccatctcctgacaactttaagaagagaacctgtaggcacctccatgggcatttcagactgtgagggcctacaggggctcacaggtagctggacgcagcccatgcacccttcatactccaggctttggagaatctagtcccagtgaagctcaccaatgccttcccaggccctgggcactccattaggccctgtagagagcaagcagcttagatagaaagccaatggcatgtggcctgcagaagccaagaaataccataatattacacagtattcacgaggagccgggtgctgtgttaagtgttcgttcattggctcttcacagttgccctccaagggaggtggtatcatcttcccactttagagggaggggaacttgctcagggagactgaataacttgtccaatatcacagagcagtaaatggccatcttgggatttaagcctaggtctgagtgactcacaaagcccaagagttaagcaaggggctgtacggaagccctggcatgcatgtccctggctttgccatatacaggcatgctgggactgcagctaagggcatctgtggggccactggaagccacagtgctgatccctggcccaccctcccctgggagaccagactgaccctgggtcattggttggctaaagcctggggcctcaagtttggtatgtggggctcgctcactgccaacgggttctccttgaggatccctttcttcctttcatctgctcaggcctaacaccccatacactgtgtgcggatagggaggtgacccctttagcgtctcagcagcacactcctgcctggaccaccctctcccaggaaggtcagaccccagcggaacctttgccctgcttgggtggaagcatgaacaactagtacagctcagcaagggactcccagtattgctggcccttgggtgtccctggcattgggtagatgacccctcatgccagggactggcctcaaggctgttcctctctactccagagcctctgggcagtgggttgtggatttcctaagagctgaccattgctgcgtcagaggcttgcagcactgggttactcaacaaggccctgcagcctggtttgctatgaaggagaagatggggtctctcgtccctagccccagtgcacttaaatgtgctagtcccagaggttgggagtcctgagtcagcctgtgaggacagggcaaggacagtaactgcctcgggtcctgggaatgtctgtggggaagaagaggctctgctacccttgagatctgctgggtcctggtccctaagtgtacctctccacccatctcaccctgagtcaggcccaggaaaggggtatctttggtgtttcctgggcttctgaacaccacattcatcactaccattctcctcagtgctggcccaaccccaagagctggagaacaggctggccccggccactctatctcactttccctggcataaaggctttgaccttgggcaacatacccagggcaacccagcacctcggcaggctggtgatcaatcttctcaacttacagatcctgctgaccatgcctgcaaccaggcctcccatctgctatctccctcagtgcacactgtcctagggagttgggtgaatatctattatagtgtgtccatgtcacagttcagaatcctgaggtcccagagcaattcaaatgcttctggctcctttcagtggaaagctgcagccagcctaaatcatctccctgtgctgggcccaggaagagatgaccctttagtataccatgttgtttgagtagccaagacctctgggagtaaaggcccctggccatataagcaatataggggaaggcgtcctgagctcctcttggggcctctctgctactgggtgctctgcaagctgggtccctgtgccctggatctctagaaatgtttctcaaattggggctgctgaacagagggcagcccagccaagtgagggcaggaagtgggcaagaaagcaggaagggtctcacagggccaccagggagggcagtgcagggcaggtggcccatgacaggtgggatgctggcttgcctgcctgccaccatcctctgttccttctggaagccatgccctgccatgagccatggccttggtgctgagactgtccattccacctcccattctcctcctccctctgactgtcaccttgagaagcatccaccctggggcttagggcagctgtgtctgtgacatgtggagccctcctcctcctcagaggcccaggccagcctccaagtgctgagatagccagctgcctgtgggcacccaggttgctaaggtatcttccaggttcagcctcctcctctccctcttatcctatcaccctctccttctattccatcctgcccactgggtccctgtgccaagccctccacctccctcctgcctccctccgagtccctgcatgactcatactttccctgggccctccctataaagtttggttccacaggctctttgaagagatccagcctcttcagctctgggcaggcaagaactaggcaaccaggccatgggtaccagggcctctgcccccagcccgggagcccctgtgttggggccaggatactatctgaacatgctgacagtctggactttggaaggggaaaatggtgcttccctgtgtgggcttctgtgtttgagctgaggaaactgaggccagagagatgccgtaatttatccagggacccagaaggggctcatagctgagctgaagagtgtcccacatcctccccagtactccacactggtccctgagtggcagccttgctaggatggcaggaatcagctgaccacttattcctgggccatcagacccttagaatagggaccaggtgggcagtgctgcctctgtgtctgaaagtggacccaccgtgaccagtgcccagtgcccaccaaggctcagccaggggtttcaccagggcatggggcactggctgagcataccacgccctctgtgtcctctgcaacactagagccctgagactagaggggcagaaagatgccagctgtcaaaagccagtgatatccaccagaacacactgaccgcccccaccctgtgcctctccttctttgcagaagctacctgtgccctgggttctctgggcagggaagggctggacaggcagccctcaggggacagccctgcctgccacttgggcagctgtcagagcatgcagatgtgcccgatgcctagctggggcacttggcacagttgccactgcaccctgcctaggggtcccagcagcctctgggcggtgggtggagtggggtgcacggtcacacaggctgagagggcccccaggacgcccccatcccacagttcccactccagtctgctgtcttctcccagctttttcccagcgccccgcctcccccgaccttacctagggacgcagccaggaagagagcgaagagcagggatccccagcgccagctgccggcctccagggccgtggggacgcccatgtcgccgtcggacgcgcagaggaacttctggtgccggggagcgggcgggacgcggccgg

SEQ ID NO: 189 - DNA, 24887 bp, Homo sapiens
  1st Promoter of C10orf54
gtgtttcagaaaatatacacacacacacacacacacacacacatatacacacacacacacatatatatacacacacacacatatacacacacacatatatacacacacacatatatacacacacacatatatacacacacacatatatatacacacacatatatatacacacacacatatatatacacacacacatacatatatatacacacacacatatatacacacacacacatatatacacacacacatatatatacacacacacatatatatacacacacatatacacacacacatacatacatatatgtgtgtatatatatgtatatacatatatatgtgtgtatatatatgtatatacatatatatgtgtgtatatatatgtatatacatatatatgtgtgtatatatgtgtatatatatgtatatacatatatatgtatgtatatatatgtatatacatatatatgtatgtatatatgtgtatatatatgtatatacacacacatatatatatatatatatccctgagataataatacttaaaaagacttagtccagtgcccagcacagtgggaactcaggaaaggtagttctgttccccttcctgaacctcttcctcctccctcccctgcaacagagaacatctgaagaacatagaaacacagaacacagaaatctgaagtagtttaattctaggccaagaggacccccagccttcccaagccatagggggctggtgggcagggcggcacttagctgcctggggcacccagtacctgtcatgaggcacttgccctggccaaaggtcactgccaaggcacagccactccagagagtcaagaggagcagagactccagagcagatggaaggagagtgggcttctggggattgcaccaaggaggaagcagaagggatgtgcagcagcagaaaaggaggaggaccggggggttctgagggcttggggtgatgaggccagagttccaaacagggtctgggtgcaggatgaggacagaagaaaacagagaacccaaaaggggcaagaggttggtcccttactttcactatcctgggaggaggatgggtacaccacacagttggatggtgcatctttgcctgtgggaacaaacagaagggccattaggtgggtgtcaggcccaggaggccagggaggcttgtccaggccagtgtccccctcctgccccaggttctcacgctagtgcctactcggcagtgttggcccagtggcagcctgcacacgtgtgcacccacacacaccctggcatgttctcaccctgcccattttcatgccactcccaggggcatgtgaatacccgctggtgcccacacctctatccgaaccatgggcccttgcactctcacctgaacagacagacacacacacgcatatattctccaacagccattcagccatccactgagtcatgccccagggcaccaatcagtcccactgatgcctatacccacagcagccatgatgtcatcatgagcagtcacactcccagcccaggtacctacagcctcacacattaaaaagtctcactgtcacaaatggagccaggtacaccctccctctccatcactccagctaactacaaacccacactccacacacccttgaccaccccatctcacccacacactccctggagtgccagtgttacccatgcagcctcacactctgcccagcacagtgtcatgaatggtcacaccatcagacaggcagccctccacacacgccaggctgtcacgtgcaggatgccctcacctgtctgcacctgcagctccatggcaccatggaccctgtgctccgagtggtggtgcctgatctccaccaccaggcagcagtagaggccgctatccagcagggtcaggttgcgcatggtgatggagaagttgccatggtggtcggaggccgactccagcccgtggcgctgagccaggtcgtggctggtgttggcagcctggtggcctccatggtgcaggtgaaggtcctggaacgtgaggttgcggatgggccggcgctctgagcaggtctgcacctcgcccctcgagctgcggtaccacgtcttgtagaaggtcacatcgtgccctttgtccacagggcccaagagcctgcaggtgagggtgacgttctgcccctcgggacagacatacagggaatacggcgtggcgaccttgaaggctgccaccggacctgctcagagagaggagagccctgtcacctgactgatccagtgctactcctggcaaccccagagcggggaagaaccttagcctctgctacttcccagccacaggccaggggcatgtcagctgacctccctaagactgccttctgcatttgttcacaaaccccactccatcctaggctgttgtagggggagtcacagaagcttccccaactaggggtgctcctggatgctggacagggcagggagagacttggagggcagtgatgcagtcgggtgtgtccctcttcccagtagagtatatgcaaaacctgttgggtgggaggcaggttggggagcaggaaggctgtttcgaacagcagctccttgtccttggccgctctgtaggggccatcaacacctctgccccttcctactcctaggactgaacatgccttcccatccttgccagggagcactaagagagcacctgcgtgtgcaaggcctgggccaggtgctgcatctcacctgcatgctgaatgcatggcctccccttgagcagacgaggcctgcattcccgacagcagaaccccatggcaaaggcaatccaatgccagccctcagggcacttggaggagggaggaaacagccttctggggacagtcagggacttcctgaaggagggagagtctttggacttggtgcatagataggatttcagccagtagaaagggtgtcctaggcaagatagtgtgaaaatgggaaaacccagtgtctgagggaccgggacagagagtatatgaaaggtcatctcatccatgcacgtccttccagccaaacttagaaaactgtctagttctgtttggtttttttcaccaagcaaatgaagcaattccctggtccactttgccttatcccaatcctccagcatttaattgggttgaccctcaaaaccatgagcttttgaaaacagaatattggatagaggccgcgtttctatctaactgtatgagcctcagtttcctcctctgtgcagtgagaaaactattggctacaatgcagggttgcaaaaggactagatgagggaaagatgagaacacaagatgtgagctctaatgccctctgcagacatctgagggatagctataattattatgcgttggtgttatttttatttatttatttgtttttgagacggagtctccctctgttgcccaggctgaccttgaactcctggcttcaagcaattctcctgccttggcctctcaaagtcttgggattacaagtgtgacccactacgcccggccagtggtatttttattttaaatggcatgtcaggctgttgtgggtctagcagagagggaaggagggttagaactatgtacagaatccaaactgatacatccttttcattgccccagccaggggcattgcccagaaccaatataatgccacatcctccttcagatgccccttccctgcccttagagcccaggaccctcggcggcaggctgggacccactggaagagctgaaagccttgcccagccaggagggaggcagcctggtggggcttctggagctggccagcctgtactggaccagtagctgtgagccacttagacgctgagccccgactcctcactcacagatgtttttcccagaaatgaaaacatctccctggcagagttgaggcaacggttagtaataattcacatgaagtgttctgtaagtgccatgcgagtagtcggcgcttggtacttgggagctagacaggtctctaattcattcagcaagtcaagaagtgcctcctaggagtgagaagcacagtgggatggagaagccagctttaaagtctttcctgctaaggtgtgaatgactgataacaacttgtgatccgatcctggggcgcttgtgtttaaaggagagtctccaaaggcaccaaagccccaaacggcatgtctgcaagagtggagttttaggcagagagccaagtctgggagccccagatttttggagtcattgtcagggtgagcagagatttcagaacttctttggcaagatacaggtctccttttcaggcagaaacacagagacccagaaagggaaagtggttggactgaagttccaaagttccagagggtatgatctcaaagcctggagcatgggggacttcaggtaacgcaggatctaggcagaaccgtaataagaagacacagcatgtgttgtgcactacgctaagggtttcatgggcatatctaacaatgccataaggtattgtttttattcccattgcactgatgaagaaactaaggcacagagaacttacgtaactcactgatgatcacacagcaagcaagtgctagagctagaattaaactcagacacatagacactatactgatgaaaaaaaaggccagaaactgggagcccacaggccacatccagccttcacacatatttcattggatcctcaaaatctttttaattttcttgagatggcaacatttaaaaaccaggaatttgacatgaaaattctgacttccagctctccttagaaaatcagaagataatgctaaaccagctttcccacagggcaactgtcagctggggctcagtagcagcttttggggggcaccggcactccagttcgccagagtccgtccgtactactccctaataattccacctggcctgcttcactctctcaccgtggtttcttggtcctgtggacatttgagtttgtgatgaatgagtgtggcttcttgggctagctggcatgggactctactgcccaaacccattatgctacaaatctgacccacagactcaagagaggagatgatccacccagggtccccagggaaagcctggcagtgcagggactagccaactctcctctgctaacccactgcccttacccctgcagcaggctcagtggaaaaggagccccaggaagcttggctgtgcccctggttttgtccgtgctggcctggacttccccttcacacctgagtggggtgggtgtagctgcaaaactatggctctgccgggaaacagaagtgaggaggacctagggaaagggctctcccacgtactcccaggaagaaacaaaacctgccccaagggggccctgtgctgcccccttccccagcaggccatgtggcaggtcccaccagcacctctcccagcttctgcccctttctccctttgcctgacatcacctcctaccccagagccaccccagggctgggagctgaattcagctccagcttcagctacggtagtatttaccaccagcacacataccttgggggctggccaaagggctggctcagcagacacggggctgcaggccagaggagggtatggcagggcaggcagagtagagctggcagccaaagcaagatgcgcaaagctgagctgggtggggttgggggccctcaagtggacagaggtgtggacaagtggggctagcgtggttgttggcctgagtgtccctgtgaacaaggtggggcagggcaccaggctgggagccctcagggtctaagcaatggggttaatgaccccaggattgtacccatagcacccgcagcagtagggaagggatgttctcccctggaggcaacttccttgagatgcacggcgggtgggtgcatcagagagaaagcagagttcagggagtacgggagagggggcattgctcaatcccccacacctccccacccctcacacactggccacccatcccacaggtcccaaaggagttgttccccttttagaaaaaagctgtcttaggattcaagtttggggagcaggggaggatgttcagttttcaagcaagagggccagacaggagagggtccaggacaagccagagggacaggacaaaccaagggtccacaggggtttgtcctggggagggagggaaggccagaaaacaccccatttactgtgtctgagactccagctgggacaaggcccacagcagcctgtcgttaggaggacactcgaaggcatggcatgggggagaggggcagcgcacagcacgcagaggggcctgcacgtgccccgcggactccacatctgtgcacatgcctgtgtgttgtcagggaagctgtgcagcccggctaaaattacaattctttggcgagaggatgttgcttattgtcaggagcagatccttttggacacctgggtcattgtcggagaccgggaaaagtgggtggggaggaaagcccctggctccagggtggccaaaagcatgtgggacaggaaaatgacccggggcctgggcctgagcatgtgccaggcgggaaccgtccagttgccgtgctgctgtcaagacccaggccccccgcccgccacccgccacctgccaccaggtaaggaggcagggccacctagaggaagagtgccgtgaacctgggaaagcctgagtctcaggagtaaaactctcgcttggattgcaacgtcctggggcctcagtgtccacttagttgtgccctcattgtgtgcccttgggcagatcccacccttctctgagcctccgtttcttcatcttaacctgagggctgccagctctaaaatcctgtgggcaggagggaagagctgtcttatgaccatgtattatgtgctaggctcttgctgagcatcttatacctgtcacatttagttctcataacacccccaacatgggtggtatcatccctattttaaagatgaggaaacagactcagagaagtgacttgcccaaggccacacagtgctgtgtgactgagctgagattcacaccttggacaggccagcactgcagacaggaagagccacccacctctccagaaccctccagtgggcaggcggggctgatgcctcatccttcagctatttagaaaaaatgaactgaccgtgcattgacctccacgccctccgtgcaacattcctgctctgcctcagacccaagctgaaaacatcattctttcattccacaaatatttaccaaggtcctaacatgggccaggcccaggcagggaggctgtggggatgcagagttccatcaggggcatctgctcagaacttgggcctggacctgtgcctgagatttctagctgtggcaccctcagatgtttctgtcccagtacaagggaaaggagctcttgttggcatcttctcagaatgccagtttttgtgaccttcacctctctccacccagcaggccccgggtgacccctgtgagtgtgcacgggatgggtgtgtgtgggtgtggacaggcctgtgtatttttcatgacagggcgtgagcttagcccacagtcgccaaggcaacgccctagcctttggaggtgggacccaagcttggttagtcgggcctaggaagccccacccaaacagctgaactctgaccagctgctagaggttgtcaagtaaacagttattaattgcctgctgtggctggccctgcactagatgcaaaaggtcccgtccttggtctcacaggacatcccaaagagaatgggacctggttccagctccccgccaggccccatcccccaggatggtccacaggctggggctggggctgtaggaaaagactatgttctgtctttatcaagatgcagagggaaacagaggcatggatcaatcaggactggggctgccaaggctaagaaaggaagcgtcacaaggcataggctcagggcctgaagccagcaagtctgccctggggctttctggccagtgaggacaaagggcatctcagatgtgtttattgatacctgcccccgcaggaagtgtccattcacatcagaccaagggggctgggaaggggaagccaggctctattgaaggaagcggcacttccagcaccttgggaaagcctccgtgcatccggggctggagctggaggctagcatgcctccccagggagggcctaggcagctggccagaggtcccggcccgtggatgcttctgtggatgaacccctcccagactccccaggcccttttggaggaggactgtgtgcagctcaggctcccggctccagccagccaccctcacgcttctatgctgtgaagacgtcctcagggtccagctcaagtctttttgccccctactactctgtgccaggcatcattctaagtgcttgtttgtttggttggctttgttgctgttgttgttgttgttgttgtttgagatggagtctcgctctgttgcccaggctggagttcagtggtgcaatctcagctcactgcaacctccgcctcccaggttgaagcaactctcctgcctcagcctcccgagtagctgggactacaggcacccgccaccacgcctggctaatttttgtatttttagtagagacggggtttcaccacgttggccaggctggtcttgaactcctgacctcatgtgatccacccgcctcgtcctccccaagtgctgggattacaggagtgagccactgtgcctggccgtttggttggttttctttagtgagctagggtcttgctcttcactcaggctggaatgcagtgacaatgagatcatagcccactgtaacctcgaactcatgggctcaagttatcctcccacccctgcctcccaactaggactacagacacatgccactatgcccagctaatttttaaatttttcatagtgatggggtctcgttatgttgtccaggctggtcccctggcttgaaactcctggcttcaagagatcctcccacctcagcctcccaaagtgctgggattacaggcatgagccactgtgctcggcctcattctaaacacttttacatagattagtttatgtaatccttccaccctatgaggtaggtactagtatcatctccattttacagatgagaaaacggaagcacagagagattagtatcttgcccacagcctcacaactaataagtgatggtgtcaggatctgaacccaggtagtcagcctctggaggtctggtgccatctgactactctctagagaatagaggtagctggggactgactggaggccccacctccttcttgaagacggacaaatgtcatgaccaatgaaagcccagcttgcctggccacgtctaccacatagttttacttttggttttacattaaataacattgaatcatatatagaagaggttattccctttacaattatttcagtcctgattacatcaaagagaaagtctcagtttgatgctaatatgtctctaaaacatttgctaatctccttttctttttaaattttattttattttaattttttgcaagggaaagcagcagttttcagactccgagccttcccaggctaaagtttccaactagaattcaatacccttatatggttttcctgttacgttcttttatggttttgttctatttatgacaagtgatactggctttccactaatgacagcgataaaaagtttccttttaaagatctacatactcaaataaaagaatgagtagatttaaagaaaaaaataagtaaatattatgaaaggcagacactgcagagatcacaaaggtgataagcaaatgactgaagctagggaaacaccatcatggaattaaccttcagaggagggtggtcagcctcactgagaccacgtcacccaacctgtccattgcacagacaaaggggaagtgtgtgtttgtgttcccatgatgagtgaacagcagaggcagggtttgaccccaggtccccatgggaaataagatcctacgcagaaaggctaaaggaatgggcttgcttggcttggtaagtagcagagcaacctcattattggattactgatgagaaagatggtggccactgtctttgtctttggtgatggccagccaaagtgaatggaccgaatgtaaaaagatcagatgtaagaaagatccaccaagataagcaaacccagggccaggcttgccttcaagttgcaatgtccccatctcctgacaactttaagaagagaacctgtaggcacctccatgggcatttcagactgtgagggcctacaggggctcacaggtagctggacgcagcccatgcacccttcatactccaggctttggagaatctagtcccagtgaagctcaccaatgccttcccaggccctgggcactccattaggccctgtagagagcaagcagcttagatagaaagccaatggcatgtggcctgcagaagccaagaaataccataatattacacagtattcacgaggagccgggtgctgtgttaagtgttcgttcattggctcttcacagttgccctccaagggaggtggtatcatcttcccactttagagggaggggaacttgctcagggagactgaataacttgtccaatatcacagagcagtaaatggccatcttgggatttaagcctaggtctgagtgactcacaaagcccaagagttaagcaaggggctgtacggaagccctggcatgcatgtccctggctttgccatatacaggcatgctgggactgcagctaagggcatctgtggggccactggaagccacagtgctgatccctggcccaccctcccctgggagaccagactgaccctgggtcattggttggctaaagcctggggcctcaagtttggtatgtggggctcgctcactgccaacgggttctccttgaggatccctttcttcctttcatctgctcaggcctaacaccccatacactgtgtgcggatagggaggtgacccctttagcgtctcagcagcacactcctgcctggaccaccctctcccaggaaggtcagaccccagcggaacctttgccctgcttgggtggaagcatgaacaactagtacagctcagcaagggactcccagtattgctggcccttgggtgtccctggcattgggtagatgacccctcatgccagggactggcctcaaggctgttcctctctactccagagcctctgggcagtgggttgtggatttcctaagagctgaccattgctgcgtcagaggcttgcagcactgggttactcaacaaggccctgcagcctggtttgctatgaaggagaagatggggtctctcgtccctagccccagtgcacttaaatgtgctagtcccagaggttgggagtcctgagtcagcctgtgaggacagggcaaggacagtaactgcctcgggtcctgggaatgtctgtggggaagaagaggctctgctacccttgagatctgctgggtcctggtccctaagtgtacctctccacccatctcaccctgagtcaggcccaggaaaggggtatctttggtgtttcctgggcttctgaacaccacattcatcactaccattctcctcagtgctggcccaaccccaagagctggagaacaggctggccccggccactctatctcactttccctggcataaaggctttgaccttgggcaacatacccagggcaacccagcacctcggcaggctggtgatcaatcttctcaacttacagatcctgctgaccatgcctgcaaccaggcctcccatctgctatctccctcagtgcacactgtcctagggagttgggtgaatatctattatagtgtgtccatgtcacagttcagaatcctgaggtcccagagcaattcaaatgcttctggctcctttcagtggaaagctgcagccagcctaaatcatctccctgtgctgggcccaggaagagatgaccctttagtataccatgttgtttgagtagccaagacctctgggagtaaaggcccctggccatataagcaatataggggaaggcgtcctgagctcctcttggggcctctctgctactgggtgctctgcaagctgggtccctgtgccctggatctctagaaatgtttctcaaattggggctgctgaacagagggcagcccagccaagtgagggcaggaagtgggcaagaaagcaggaagggtctcacagggccaccagggagggcagtgcagggcaggtggcccatgacaggtgggatgctggcttgcctgcctgccaccatcctctgttccttctggaagccatgccctgccatgagccatggccttggtgctgagactgtccattccacctcccattctcctcctccctctgactgtcaccttgagaagcatccaccctggggcttagggcagctgtgtctgtgacatgtggagccctcctcctcctcagaggcccaggccagcctccaagtgctgagatagccagctgcctgtgggcacccaggttgctaaggtatcttccaggttcagcctcctcctctccctcttatcctatcaccctctccttctattccatcctgcccactgggtccctgtgccaagccctccacctccctcctgcctccctccgagtccctgcatgactcatactttccctgggccctccctataaagtttggttccacaggctctttgaagagatccagcctcttcagctctgggcaggcaagaactaggcaaccaggccatgggtaccagggcctctgcccccagcccgggagcccctgtgttggggccaggatactatctgaacatgctgacagtctggactttggaaggggaaaatggtgcttccctgtgtgggcttctgtgtttgagctgaggaaactgaggccagagagatgccgtaatttatccagggacccagaaggggctcatagctgagctgaagagtgtcccacatcctccccagtactccacactggtccctgagtggcagccttgctaggatggcaggaatcagctgaccacttattcctgggccatcagacccttagaatagggaccaggtgggcagtgctgcctctgtgtctgaaagtggacccaccgtgaccagtgcccagtgcccaccaaggctcagccaggggtttcaccagggcatggggcactggctgagcataccacgccctctgtgtcctctgcaacactagagccctgagactagaggggcagaaagatgccagctgtcaaaagccagtgatatccaccagaacacactgaccgcccccaccctgtgcctctccttctttgcagaagctacctgtgccctgggttctctgggcagggaagggctggacaggcagccctcaggggacagccctgcctgccacttgggcagctgtcagagcatgcagatgtgcccgatgcctagctggggcacttggcacagttgccactgcaccctgcctaggggtcccagcagcctctgggcggtgggtggagtggggtgcacggtcacacaggctgagagggcccccaggacgcccccatcccacagttcccactccagtctgctgtcttctcccagctttttcccagcgccccgcctcccccgaccttacctagggacgcagccaggaagagagcgaagagcagggatccccagcgccagctgccggcctccagggccgtggggacgcccatgtcgccgtcggacgcgcagaggaacttctggtgccggggagcgggcgggacgcggccggcgcggggaagcctcccgcgactgagtgcgagcgagtgagcgctgcgggcggccccagcgccgtgctccaggcacccgcccccttcgcgcagcgcccccggggggccgtgtgggggaactgcctctccgagggccgcgtgggaggggcttcccggaggccggccccgtgggtggggagccagcgtgcgtcccagcgagtcagctccacttgatcggcagtttaaagcccgttctaccgtcccccagtccttttggagagaaattattattgctgcgcagcctaagaagtagatctacctctaacagcgtgatagacgttaccatggcttgcatctgccctcagccaccagcctttgagtgatctggggacagagacttgtaccctacatcctccagccagaccagggcttggtatgtggtaggcactcccagctgtggaatgagtgagtaaatgagtgaatgaatgaaatctgacattgtgaagagctaggcaagctggagccagtttaactgtagattcagagcctgaggcaccctgagtgcatgcgcgcgcgcacacacacacacacacacacacacacacacacacacagaacaggtgcaggactacacgccaagatcagcacatccctaccccgggacacacacagatatgcaggcaacacctgttggcgtgccccacagcacatcctgcaagctcccctccggcagaggcctcagctgtccgcctggctgtgcacccgccctccctccctggtgcctggatatctgcaggacactctgatgcaccctaacttctagtgcctctgctcttgcacccacacccagcactgctggcaccactggaatgtctctcccctcctaattcttctcatccctcagggctcagctcaagtcctcccacttcacgaaatgtcctgacccttcctttttcccggcaaatccttactgtccacacccccttcagctaccacctccagcctgagataaccagcagttggttcttcttccggctgttctgccctccagagcgaaactacaaacctctctctgatgtttctgagaccctagcacaaagctgggcgtggagaaggttttactgcacttttatctgaatggacaaaccaatgagtgagtgagtgattgtgtgatggaggagcagaggtgatcgtggccaggaccagggatcacaggagtggaagagcacagccattttactcagtttaccccagtctagctgaagcttccaggggtttttctggcactttagggatcttgggttaataggtgactcctaggctgagaggcagaggacactcagagtctgactgggtcaggaaccagggtatcaggactcaatgggagccaggagtcctgggggccttgtgggtggcctgatccaagtcacgggctctctggaggcccttagcccttgctctaagggcagggaaggctacaacagaggaaggctgaggcatcatgttattactaagtgaacttgtgcaggcccagtccccctggagccagtgaactccccaggatgggagccccagaggctggcaggacataacccaggtccttgggcatgctcctggccttgtgaccccaccttggaaggcagcccagggcccttcctgctggcatagcatgagctcccttccaccaggggaggtacaaagccaactgagatcaggtggacaccgggcccttctcaccctgacatcctctggcaagtgaggggggtcccttaagggcaagatcctagagcaccaccccatctcaacccttcctggactggctttgctcaggacacccttgaaaccagactccctcttccccagggcctagcagccggggagggcctggaattagagaaaggggagcaattgccctgccaaccccttccccagggggatagagcctctgagctgggcccagttccctccccccttttcacttcctttctccctaccacactgcccaccactgagcctcctggggttgcatcagggtgagacacaggcattgcccaaggaccatggtccagaaacctcaagcactgtttcctcaacaccagggcaggacaggaagggctcagctgagagggcctttggagcactgactttctcctccctccgagaccagaggaagtcaaacccaccttccctccccaagcccagacctggtctcagagcaggaggggctccaaggcccaactctgttcaaactctccactcccagcccctgcagcctgcacactccatcatgtgtttgtgcttgttttcattaaaaatagtggtgaaggccccaaatattcgaataaagatgactgtcaaggaaagccaccatgtccatcttgtggctctgcagggcctggaggcagctgtgagtactctctactggtgaggggcccagccttgagccttcctgagtccccttacttgccggcaagaatacaagagcaccacattgcaggaaaggggctgaattccagcctccctgttggggaggggatgctgacatttcccacattcccaaactcacctcccaaactccctgagctagaaacaactttagaaatcaagccaggtcctttattaaacagacagaaaaggtccagagaggggatgtgacctgcccaaggccacgcagctccttttcaaggctgccaaccctatctgctttggaaaccgtttcagcaaacacccaatgccctccacccccaagatccagagctgcatatcagaggaatcattgcctcctcaggggcagtgacagccttcttgggtccagatcccctgcccatctgtccattcttccagtggtagctccagagccagccagtcccaaggaaaaaaccatatgcaaattgcctacattgagttgtctgtaccacctgctttctgttctctggcctggcaatggcctagtcacgttctctctacccagacacctttgcagtgattaacaccttattattttatattagtcactcattatgatttgtattagttagggtcctggcaggaaacagatggcacactcagaaagggttcaactgaagagagtttaatacagggactgtttaggaaggctggtaaagcacccagagactagcaccaaccacaggaagccactaccactcacatgtccaaagggaaagaagaggaagtgatgttctggagcccagtgaaagctggtgctatgaaagggggacccctgtccccaagcaggagaaacacagccatgggcagaaccgcagtgaggaatggagggagtgtggaagaaacacccccgcctctttctccccactgctttcatcttcagccagggcctcccattggccacacccagcaggaagctggatagcaagggagccagggtaaggcagttagtccacaggggacatcttcccaggtggagaaaggcaggaagcaggagcaagaaccatttctagttgattcttgagtgctgattgccgagttctgattagctgaatattacttgtggtccaattgactcaagcattggcagagatggccgatcacaggagagtatgttgtagaagctgttcttggaatgaagttatgttctgtgagtcttatttttcacaggtcaacaagttctgcccacgaaattgccacaaacccaatgtcctccttctggaaatgctgaaaatatgtatttctttcatttacatgaacaatagatgaaggttaaatatggcattgggccgagtgcctcacattcttgcctcttgtagtctggcaggacatataggctcaataagacacaggccctcgtaaagctctgagctggggtgactaccagggttcatcccatatgccagtcttaatcactagaccactgtgctaacaaggatcccaagtttgcatctggcctcagcagttctgtgattgattagtgatgtctgctgggggtcgcagacataggagtggtggtgccagtgccatcttggacagagcagttaccttacttggcttttggtggagtttttgagctttctctctctaccagcctgtgacccaccccctgctttcttctccttgccctttctgtttgagtcacatggagtgagttcagcccaggagaacagccatctggatccaccttggtccctctggccacctgaccaaggacgtgacccactcttttccacaggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatggtcagcagctgatggcaggatcaagacaaggggcgaaacctatccagggattggcaaggagttcagtgacactggagggggatggagcaaagatgcagtctaggggaaactgtgggggcactcagtgtgggaggatgaaaagtttggtggagtggagcctgggctagggggtggcagtggttccccatcacagctccaatgtcagggcctacttcccaaattggtcagagggtgctgcagacctaccacccctagatccatccttgtcccttccctgtgtcccccagggtgtcatcactgctgccaaagagctggactacgagatcagccacggccgctacaccctgatcgtcactgccacagaccagtgccccatcttatcccaccgcctcacctctaccaccacggtgggtgcatgggacacagccccaacttgggcttggaggttggcgaaggatgggacccagaaagctccgatgcgggaaggggttaggggaagattgtctgagggaaatgcctaaatccaagacccctgtcctaatctcagcaactcactcaaacttgctgtgtgactttaacgaggtcactgaacttccctgtgtggctacatctgtcagacaagtgacaatacctgccctcctctccttcatgggaaaaccatgaactctgggtttcaagtccttgctcttccactttctagctgtgtgaccctgagcaagttgcttaacctccctgcttccatttcctcatctgtgaaaggaggacaatacaaactatgttttaaggagtgagaggagtaaatgaaaccacgtaagacaaccacagtgcagcaacaaatagaagtttatgggcagtactattattatttttttgagacaagttttcactctatcatccaggctggagtgtagtggcttgatcacagctcactgcagactcgacctcctggactcaagagcaatcctcccacctcagcctcccaagtagctgggactacaggcatgcaccaccatgcccagctaatgtattactcttttattttttgtagaggtggggtcttgctatattgcccaggctggctctgcctcagcctcccaaagtgctgagattacaagtgtgaaccactgtgtctggccaatagcatttttattaatatgatgattgtgcccataaaaggctttggcaataatgataactcatccacatgcatagcttaaaagccccacccatatccgacttcccatatgattcctgcatgggcctcatgaggcagaattatcaggtccatttcacagaggaaggaactgaggcccagcacaaagctggctggggtgaggccttggctaagcttttccaccatctcaggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggtgagtggggcttggggcatgccacccacagggtctcacctgcacacccgctcaggggaggataagaagggaggtctcaaggcatttggcctcaccattgtgtgattttgtcctctctgggcctcagtttccccatctatgacaatgatggaaataatcttctcccacctcttattcccagagatgtggcgagaacaccctataatctgggaacaagggctggtggccttggagggacacagactcctttaagaacatgattaaaaaatgccctgttgcatacccagaggaagggccccagggcagacgagggaagcacatccttacagtgcgtgcagaacacagcccccgccctcaggaccacaaacccacacaccaagggagcgcctggcttgctctgcacatctcatagtcacccattcacagccctctccttggatgaagagcagagtttgccttggccttgagggcaacttctcaagtccattttcactcattactatagagtgggaatcccagatccaaaggcgccagctagggtcaggcaaggagccttcgtgggagatggtgtaggaaagaatcaggagcagtggggactgcgcagccacaactcagctcctgccagtagtagctgtgtccagatcccagcctgggagtacctgggcccattttgaaaagaaaagcagaaatccaaatctttgtgaaacatcctgattttttaattggtcgtgcaggaaatatttcttgagtacctccagtgtgccggccatgttccaagagctggggataccaaacagatgcaaatccctgccccgtagaacgtacgttccagttggaggacacgggcaatgaaccaactgactaagtagatgacttagtatactgggaggtgctaagggctatggagaaaaataaaaccaagccggaggatggggaatgccagggtgaaggcagcaattgtaggttggcaaaaacctgaaggagggcaaaggtgagtcaagtgacatctggggaagagcattccaggcagaggaaacagcaagtggaaaggcactgaggttggagcatgcctgggatgttcacagagaagcaaaaaggcctgcagctgggggaaagttgagcaaagggaagcataggaagaaatgagaccagagaggtaatggggccagatgttgtcgggccttgaggggcatcatgagggcgtggcttttgctctgaggtgggaaccctaagagggctttaagcagaggagagacattatttgacttaggtttcagcaggaccactctggttcctgtgatcagaacagactgtaggggtgaaggaaaaggagcagggaagtcggatgggaacctgctgcaatcactcaggctagaatgaggtagccgggagagggtggtggcatcaccaccaaagggaaagaggtggccacctctggtgtaattcagaggtggagccagtaggatgtgctaactgattggctgtgggatgtgagagaaagtcaaggttttggcgtgagcaacccaaaagatgatggcgttgccattgacggatggagggctgcagcaggaggttgtggagggaaaggagggtcggttcgagataccaggtagaggttgcgtatacaagccaagagttcaggagagaggtctgggctggagacgggtatttgggagttgtcagcatagaggtatttaaatccaggaaacaaagagcggtgcgaagattcaacagtgaacccaagcctcgcttgcaattaagaggctgggggaaaaaacaacaacctatatatggagggcccaagtgacagaatgagagcccctgctgcccagagcttatgaggggtcactctgttcggacatgctaccctttcggatcccaaagtctcctctctggccaagcactaggccttcctctttggaaaccagcagagcaagggcctttctcttctgctgttttcacaaacacagagattttgtaattttatgggagtccctggagcacaggaggatgccggcacctggtggagaggcaggtgctgggtgagcagctgaagcccctccccatgaggggcccactctgcaccccagcctcaaggcacagagcacacacctgtgctccagcacagtgcagacctccatgccatggcctttaagccacaagcgaaacttcctgggttcaatccacacgtgattgggatgagccttaagaatttggggccttgtgggggagtcccagcagactaacaggcaggctctcaaaggagtgagagacgcctaggagtttcctaaggctgacctgggtgggaggcttcctcccccaaggaaggaagagtagacatttagagcccaaagataactttggggtctctgagcgccacccgcatctcagaaatgatcaatgaaggcccagagaggtgaggaaggcctgatggtactgctgacatgggtcacgacatccatttcccacatctcctcccacctcggggttcatgttggtcactgaagggttgacggatgctacagccagcaccgctgtctggagagagctggtttcacagtgcaccactgcatggagggacgtgcctgggaccccagcttaaaggtcaccttcccaacactgcagcctgaggctggaaggctgctttctatagggagacagatgccagatttctgagcacttaccagccccactgagcccttaggaggagctgtgtgctcaaagaagagctgggagacaggccacatgcacttgagcctctcccgccagcgcctgccttctcagctgccctttctggtcacacccattccttggacccctttcctacatcctcaccctccctgaaagctccccgttccttcagaggcctgcctgggctccctttcgggatcagcacacacaaggtgggccagggtttgtccagcatcagcacaaccccaaggtggcatctctctattagcccatttttcagatgagaacatcaaggcaaggctccttaacatgcccaagggcacacaggcatgaagtccagatgcagacctagatatgattggacgaaagcctaggcttttaacctcctgtctccaggagttgtggagggatggggaagtctggccccagagcaagctgccaaggagaagaatttgcacaggggaactaggctggcccagcccccagcccctcaggcctgcctccctgagccttcaagggagtggtgctggtgtctcctcctggctttggaaggagagcaagaggccctctgcctgcatatggccggggcttgagacagggctgggaaacacctagaaagggaatccccagttctttggagaccttggggtgtcatgctcaggaaatcctgctttaagcagcttccaccccccaggcagggtgaagcctatgggacgggaagagcctgggagcggaagggctggtgggaaatcccagctgcaggtgggactgagaggggctgtttttgtacatcagagtgttaggagctggggacagggaattgtgaggtaggatgtgaagagacaggcagagaaaactgtgggggcgcctgggcccctgtccttgccatgccctgtgagctgtgtgcttcctgctgtctgtcccagagcaagtcagtgccccattctgggcccttccccctaagtattcaaagggaaagtgaaggaggtaactaaccttctctccattccatttcctgggggaatgcggagaggtggcctctcttctgcaggctctcccagttccctagctcacatcccctcaactttcttcctgccagagccacagcccccaccattcttgcctctccagctgggctcacgcttgctcactggtttccttccccctgtctcttctctccaccctccgtgttctcaccccgccccggtcagctctgagtggtgctgtctggaaagaacacaagtcctgtgcgaggcaatgggttaagacccagagtgctgggtttgaatcctggtctgtcattcacttgctgcaggagtgcagacaagtggtaaccctcccctgggctcccagttcattctccaaaggacacaagggactggacggtctctgggctgccttccaggtcagcatctgagaatctgaggttcttgctctggactgtcagacatcgggccctgcagcccagccaagaaaaggattctggggccacagggccagcggggctcttcagaaacatcaaggaaaggaaatcagggtcaccacaggtgtagggaacccactctgctttccaactatagctcaatatggggactaaatagagggcactgggggcttccctgcccctcatccgtccccttctgcctgcccggtgcctgcgcattcaccattagcaaagcattgctttgtggtcagctctgcccttcccaatatccttttttacaagccatggcatgtgggatggatcgtacattgcgaagcacctgatgccttcattgatcaagagtgcttagacagtgggtgctagtgtagcaagaagcccccactttttcaacatagccatcttacccaggtcagtctctggcctgcctgtggcccagggaaggaagctgcttggtctggcacatgagggcatgagtggcccgtgtccgcctgcacccgtggtggtgatccgctaccacccacctgcacatcccagcccttgcagatctcatgaggatctgaagctggggtcactggaggacccgggccccagctgtcccccacctgtgacgagtgaggcttgctagaggaagcagaaggagtcctggggtctccacagttcctgccaatgcccgactaacttgggcctctcctggtgacacccaggggagtttgtgatctctcctgtggagggggtgctaagggtccggaaggacgtggagctggaccgggagaccatcgccttctacaacctgaccatctgtgcccgtgaccgggggatgcccccactcagctccacagtgagtctgggggccccacccgctggcttcacctcgctgcccctgtacttgccacagagattcttgtaaacattgttacccttgtgccaagagaggccacaggctgccctggagccaggccaggcctgcccctggggcccttaatagacctctcgccacatccagcaactctttggggaggctgcctttcagcgcccctctgcacccaacccctgccccatcactcccttctccatcactgcccctcctctgcctctgcctttcctgcttc

SEQ ID NO: 190 - DNA, 12005 bp, Homo sapiens
  CTCF Binding Site within C10orf54
gctccctgagaggacatgctcgtcctctctcctgcttcctaggcccagccccatggcaggaggcgcttgctgtcgctccaggtttggacaccccagagtgcagagggagaagtgatgaaacccgccagtgttcacacagctttcatctgttccgtgcattaggccgtgtgtttgcgggtgttagcatggcttgcatggtctagggggtcgagggatgctggctttggagacaaaagtgtgtaggttcagacctctggcatttgcaagctgtgtgaccttggctggttgttccatgtttctgagcctcctctctgtgaactgagaacagttgctttctgtcaaggttgccgtaagaaccaagtagagtccaggtaatgccgcagcgtgtgcccaccccagcagcgtgagcacaatcccctctaccctgggaagacgtcagtgccatgggactcaagccccactcttccaggccaggatactgatatctcctagccccggaactttccatgggtgctacactacctccatgggcctgcacccccattttgagggagatgaatcacttctgcttaaaacactgcactcccaaaagcccttgctcaacagagggcccacgtgggcagaggaggaccagggagtcccccttggcttgacctggccacctctcctccacacctgctcacccctcaccctctcttctccccacaggtggtcttctccctggcctctggcaacatcgcgggggcctttgagatcgtcaccaccaatgactccattggcgaagtgtttgtggccaggcccctggacagagaagagctggatcactacatcctccaggtggggcctggcctcccttggactgagagaccactggctaagtgcctagaccggtcactactctccatccaggagagagcctgtccatcagcacactctggtggtcagtgcccctgctgtcaccaagtaacatggggccagctgcacccatcggggccaagagcacagtgaggctgacccaggatagggaaacctgggagggaccttagatacccaggaggaggtagttgaggtgtcttcccctgctgtaagagccaggaggatgagggagagcctggtggagctgggagagccccagctcttctacaaatacagtgtggccttggacaggttattaactctgggcctcattttccccacctatgcaatgtacaaaaaaatccccgtctggcctgccctgtggagggaagaagcaagtgcaggcttgaggagccacgaaggctatcattattgcagaatggccatggctgggatgtttgccaagggctttctgggaacctcaggactgcgcttctgcagagggctcagctcctgcagcacttatgactgcatcaaggctcccaggaacaggctcagccatagggcgccagctcattgcttataatattacttgaggctcttttcccgtttgccagagatcatgggacagagtgcgtgggacagaggcctttgaagctaaagacaggagccttgggtcaggttgcaggcccagggtcatggtcaaaggctggcacagcccagaatacagtcagaggtaggtcaggaggtcaaggcttgggtacatgttaatcagattccaaacgaggatcccaagtcagacgacgattgggcaagaatcatttgcagcatggggcagaaggtgaaggctttggggagagcccagggctggccgggagagcccagggctggccaggccacccaggggttctcagtgagtctctttgccctcccaaatgctccccactgattgcacagcccttttggactccatattcccaatcctgcccgccacgctttagccctgactccagttgccctcctccttgcaggttgtggcttctgaccgaggcacccctccacggaagaaggaccacatcctgcaggtgaccatcctggacatcaatgacaaccctccagtcatcgagagcccctttggatacaatgtcagtgtgaatgaggtgagggcagccccggggcccatatagctggacatacggggggaccgtgggcacgagccaaccatgcagcccctgtttaaatgtctgcctggcccactggtccctcagatctcatggatgggaactgtggctcattcgtagtgatagccctaacgcctagcctggatcctagaatgcagtatctttttggagtagaggagaagagaaaagagaaaaagaagaaagttgcctttcaccagacaggaaactgaggtttaccccgggagcttgcttttttaaaaaatgtatttattattcagccctaagactgagccactccaatctgccctggcattgctgggtatcatgctaggttggacgttcatgaaggcaggatgacatgtggccagagtctagctctcaggccagactccctcacttcagcccactgattggctgtgtggacttgcacacattccttccctgcacctcagttttctcttctgtaaatgaggatgatgatgccagtacctaactcacagagttggagagaggacccagtgagttaatgcaggccccagcatatcagaggtgctcacagaatgttcgctgctatcatccttattatctccatcattgctctggggtagatgcagcaaagcttttgggaggtacagggggagccttcgggctacaggagcaggtgccagactgtgccccaatgccttgagtccagaatgactgctctcctgctctcctcccagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggtgagcgatgggggtggccacagggaggagcgggtgggccagggcagctccgcctccgagtgaggggaacaagatgggtgagaatggaattccacacagcaggcgaatccttgacaactcctttagtccatctgcctttagtccatctgcccaagatggcctccccttacggaggcctgttgcgtgcaaagctggggtgctagtttggcctcccgagtctatagctactcagaagctctgtttagtcctcttttctctcacagagcagctctatggggtggtacaggttgagcctctgtattggggcctggcccagggagcaagtgggtatgaatctagcccccgcttcacttgcccacctatgcactgtgaggtcacaccaatgtgcatggtggtgtcttacagaaagggtgcctctctggccctcttcccctacattgtgtggtgtggcatgctgtcacaacacgtcagggtgggaagggattcgtgtctgtggttcacactaacgctcgaatgaacagcaccactgcccaaggcaatgttcaaagtttgccaggtgagggaaggacttgtggtcctcaagggctggatggagatctctaggagctgatgagctgtgttgggagtggcttataaactgaaagcagggaatttggagtcaggagcactgtggctggctgcatgatcttgagcaagtcagaacctctcagcatatcgcttttgtcatctgcaaaagggagataatatctacctcataggtgttgtttggggaatcaaattagctcatgtctgtggaagcacttggtaaaccatgaggaggaagaggactgttattagttctctattgccacaataatgctgccttacaaaccaaacaaaacagaggagtaaaacaataaccacatagttagcgctaattctgcaggctggcaatctggacatggcttagccgggtggttcttctggtctcagctgggcttctgcatttgtatgtgggcagctgcctgtcagcagggtgctatgcttctgagggttggctcgccagcagctggggtgacagggacaactcatcctccagaaggctagcccgtgcctgttcttatggggctggaaagtgtccagaagagacagcagaggcgtgcaaggcctcttgagtccctggcttggaactggcacaaggtcacttctaccacaatctgttggccaaagcaagtcacaaggccagcccagactcaagctatgggaaaataaactctaccttctgaaggaatgagctacaaagtcacactgcaaagagtgtggttacaaggaaggtgaagagttcagggacagttttgtaatctgtctcctggaaggaccctgattgcaaatgaggccccagctctgtccctctcatagcaggttagacctctcccctttgacagcagcactgtgggaggtggggtcacaccaggtctgggcagggctctttgtctggagcttctctggagatgttggtccaataactccaggaattgggattgggttaataatccaggaatccccaccccaccacaacattctgaggagtccaggaaatgagactgactctgggcacccctgtgggcatccttagccccatggctgcacagtgtcatcactagccacctcagccattcacacccagtgggctaaacaaggatacatttataggacacgtgtcactcactgggcagggtggggctggggcagagaggggtatcatttattgtgttaacgtgggaggacccagtttcgacatgaccccaccccactgcacttggcttcagggtggatcatcttggtcgtcccttcaatagcatttgtgaagtaacagaaactgactatggagtcataaagaatcaaaatgcattttcctacagagcaaaaattctacagagaatgtggatttcaggctcagaggtgtcagagctcatgtttcttggcctttccctcatggtggcaagatagctactataactctaggcatcaagtcagcatccaaggcaggaagatgacaaaaagatggcaaagggctatggcagctacttctgcccttttatcaggaaagcaacaggtttcccagaaccaccctccagagtgctgcttgtgtctccttggccagaagtggctcacgtgggcaccctagctgcaagggaggttagaaaaaatgagggacaggattatcatggtcagcatattacttgggggccagatatatcacttcccacacaaaagcaggcctctgtcagtgaggaagaagtggagaatggatttggggtgggcatctgacagcatttgccacactgccctccccaatcctaatgcaggccagtcaacgcaccacccccactccccacccacactccaacccccacagtcctagggtctctcagggagaccatcggtggaatccataacattctaagaccctgcagtttgtaggcaaaatcaggcttcctttgggtccccagaataaatgggaattgaagaaatggaaaatcaccctggccacagttaatcacccagaatgcatgggccactatccaagcaatcctttaaaatcttgggattggtccccatggctaaaaagagtttccatctgctggccaaaccctctgcagggacccatcccaccccttggggagcataagcattcccacctcacatgtcagcccctgacattctggttctcactgaagcagggctcagcccataccagctccccggtgagagcaggagaagctgggtagcatccgccctgctcatcctggtcatcaccagctctgctccctgaggccccagaaaacaccctcaggatgattaggaccagggaccctgaggccatccatctccaggggaatatatatggggcttcctgggctgaaccatgatgctttcttccagaccgtaatataaacagcaacaggtaccaacttgaaagatgtataggaaaacaattttaagtcgaaaagaatccatccatcttcaatttttccccctgcttctccaagttgggaaaatattgctatcatttggtttttgcaggggacacctcagtgaagaattgcagtgaccatagggacatagagaaactagcactaaaccatatttattcattcattcactcattcactcattcactcattcattcattcagccattgtccctgaatggccactatgtgccaggcactggagataccgaaatgaagaaaatgtggtctgtggcctgaagaaatgaagttgagtaagggaggcaatgaaaacactggtgtgcaatggggcactgagaagggcttggggaaggcttcctggaggaggtgacacctgggccgagtcttgttggtcagtcttggttagcacagccaagaaagaagcatattctggggttcagcctgcacaaaggctgaagagcaagcaataatcagggatgggttctgggagccacaggtggtttaggcccggggctgcttccaaggccaagggcaggactctctatttccatatcctcccgggacagtgtatatgggactcgccataagagctgctcccgctgccttctcaagaccccccctctactgcctccatgcctggccgagccaaggtggggatggggcagagctagcaagcaggggtcctgcagcccacagtgcctaccagggtagcttgcctccaaggagcactggacccttgaagatttgcttccactgaccagaccctcaactttgggcagtaaacccctcagggttatgaatatccccaagagcagagcccttctctgcctctgggcagatttcactggatgcgtgtatgaggaaggagcattgtcccagcccctcctagagcaaccagagacctgagcagcatgcagccaaccaccctgagattccaggaatggctgccacagtctaatgggtgagacagcagctgctaccctgcatagatccatccagagaaagccagcaggcccacttgccatccttttactcccactgcagttatctgcctggcttcaaaatggccttcactggctcaggaccaaccttgctggaggacaagggcatgaaagattcattcatttgttcatccaacaccaagtatgtgttatgtgtgaggcctgtagtacaggctaggacaccagagatacatcaggcacaggtctgccctccaggagcctacggtctggcaggggaaggcacatgtactggagagctgacactgtgatgtggtagagtgctaggagcctggaagccagggcaggttttctggaggaagcatcatttgcatccctgttttgaaagatgtggctccctaagcagggggcctgagatttggctgctaagaccctccccagagccaagagaaattctctgagtccctccagctctacttttctccctgagaccctcgtccccccaggttcctgagagctggacattcctgcaaacagcctaggccacccccatccggcctcagcccatatcacccgaactcggaacagctgtgctgcaaggggtatctgggccagacccaggcccgccacacaatggtgtgccactggccgggggagtcattgtggagcctcagcccctgcctagctccaggccatgggaagacaggccaggcttgggggaggggtttaagtggttgtcagggaggcccctgcaaaggaagagctgggcccagggaggaagggcggaaggtaactgggaggtcaggagttagcccaacctcagaggcacttggcagtggggtggagagggagggagggcctaactgtggcctccctgccacgtgaattgcagccaaccgatactactattccagataagaagccctggcttctcaggctggtgaggacctgcagaagtcacctatccaggcagaaggacagaaatctcccaccgcccccttctggtatgcaagtccccagcagcggccccgtgacggtctatgagctggggacactgctcttggcagtacacctcatgtctttagagcagaggccccttctgtttattagacttggaccctgctattgtgaactctgcttcccctggcttgagatcagaaggtcccagcctggccctcaccctctgtggcaccaagaaggctggccttccctgacccagcacaagtacatccagacccttcccttggcctggcttcttgagggatgttccacagctgcccagatgctccacatacaactggctaagttcctccaagagaccctggggctcagctgctgagggtttctcccttccccatcccctaatgcaagcaagaggggtgcatgggccactgtgcctatcaggagtcctctagctccacagttggcaggcagaaaagggagtggcaggagctgatatggaaggagcctacccatcagcagcagcgtcttctggacccagaagaaggcccaggccagggcaggcagagcacagataggaacgtttctggtgtgcagtacagtggagccctggacctgtgggcacaagttcatctcccagagcccttgtatgtgctctaagcaagtccaaggtgaaggccaagccaggccctggcccataataccaatccattcagtgaggaggaagcaggagacccagggtttagtcgtagttccaccgtttacttgttttgacaagacacagacctttcagaacctctattgccctctgtgttaaatggcagcaataaaacctcccaggattttcagggaagggggtggatcaaacaagttacaacacatgtgaaagtgtgttggaaagcaccaagtattctaacagaaaaggccaagaaacagcatgcatgctgccacttccctctcccgtgcccaaggcagacatggctatctatctcggcactgtctcaccaagctatattgatcattcagaatccctctcaacacattccaggatagttagggtgacatagcctccatggggtgaagagaagcagcaatgcaaagcagggaatgcccagggaatgggccaggtggcctgtgccgtctatgggctgggcctcatgctcagctgggctgtggctgggcttcaagaggcctttgttcccagcatcctggttagcaaccccagttcctctttcgtgcattgtggttccctgagaaaacgttaacccagcccccagcacagtcaggccagccctggggaaggcctcattcatgaggcaggaccccaggggccaagttggtgctcggtggtggcaggacccctgcagccccctgtcccactgcacactcccaagtccaccccgcgaggagcaccccctgaaaaaggccatgtatcagcccctctgccctgggccactgcatgtagtgggagctctggtcaggcagaagtcttttgaaaagcaggtcctggggctcctgcacctccaccccagcgcccatcgccacggactcccccaggcagggccagcctgcccaccagcagtcaccagtggcctccatggtgtgtttttagggagtgctgagcagtccccgctgtgtcagcaaaaccctccaaatggtgctttcaattccattccttcagcctctccctgggagggaataaaggcaggaagtctctattaaactgtgaatgtcaggagataggtaagatggcccctaattcctgattgatctcctaacaatgaattagttcttaaaagcatggatttccctctcagggcctcagactgtgccacgaatccagcgctccaggagcctcctgccccagcccctagtgctcctcccgccccctggaggcgccatgttctcgcacccagctctcccatgcaccccagcccacagccaccagggctggcatcagaggcactaccatcccgggcaactcagagggcggctccagcagcctgcccctccccagcagcagcagggagggacgtccctagtgcgttgtaggcagggcctgtggccatggatgaagatggaactgggagctcagagtaaatttcgctgaaaacaggaaaccacgaagcccagatgcgttcagttgtaaaagggtccagagaagagagggcagggccgcaccagaggaagctgaggaggaagtgcggtggctgttctgctgcgggccgcctccctctccacacagcagcagccaggcctggggtctggcagccaaattcttagaagttgtctctgcctcaaggtcagcagctgagggctggggccaggccagcctccccagagggcagggcatgctcttcctgagttgggagaaccggaatctgggctgtgggcttgtccttcgactccaggaacagcaggtgtcctgtccccactcctgccatgcaggcccccatgaattgtgaaaaacataccctctttccttctttctttctttttaaaatttgttttgaggcaaagttttgctccgtccccaggctggagtgtagtggctcgaacacagctcacagcagccttgaacacctgggcttaagcggtccttccacctcagccctgcaaagtgctgggaggacaggtgtgtgccaccatggccagccagcaccctcttcctatggcagctggcatcaagcattgtggtgaccagagggaacaaaagaagggacccccctctgcctagggacaagggagaagccggggtttgggcatattctggccactcgaggtgtcagccccatctccgggcctatgtttaccctctcctcaaagcccctggcccagcccaggcagagcaggaggccctcagtggaccattcctttgggcctaactggggggcttagaagcagggccatgtgtccaggtggggttccctggctgtagccacaggcccagggctcactgctgccaggcagcctagaggtgctccccttttccatccccccaaccccccaagcaattgggcgaacatcttcccgcctagccccaaatcctggctttcagcacccaggcccagctcagcagagccagtgtaggctgctaggagacaaatgcccaggctggactatgctctccacagtacctggggcccccatcctgctaaacgctacagggggtctgcccagccccacctcacctgtccccatgctcaggcactgccttccctgttttacccccagagtgtacagagatgccccctactctcctcccctgctttaaaatccttcaatcacaattccacagaggactcaccttgcctatgtgtataaaaacaaagccagggcatgcccacaagcaggagatgggaacatcacccgcacctggccgaatggctctgaagcgaagactccaccaggcccagattgtatggagtggaaggtgggggtgggggaggagcagcagagtgcagatttaaactggctcttacaatccatctccagggtttgcacctgtttccccatgtagtttttaatagcatcccgcttcatactcagaagtgtcccagggtggacaagacattgtgtggcacccttgcaatggcccgcgctgagcagtgggagtaggggatggggagggcggggggcaggtgcccctctccactcaccttcccagaaggccccacccacctccctcagcaccatctccagtgggtggggcaacatctgtcctggcctcagattgcccaagacaccatttgctcacggaggccaccatgccccaatatgtacttcccgtttcgggaccaccaagctctggggactggaatgcaggcagtggaagccccagattgacttaacctgttgacagatcttcagagaaactgctggtaggaggcagctggggaaggtggcgatggccagtgggcaggcaggcctggccccagagccactgtggtacaaagaggaagtctgacagaagagcagcctcgggcaaaacgggggagccaaggcggccacgggggagaagtctctccaccgtgccctgtgtctggtgcctgggagggtggcccagtgtccatcttgtcccactgatgctgccacatcccaaggctcatgtctcagaacgagagct

SEQ ID NO: 191 - DNA, 29754 bp, Homo sapiens
  2nd Promoter of C10orf54
gtgtgggaggagggctcctgggcttccacgaagtgaccgttacagtgtacagtgccggctgggacccagtgtggccagaataacttcaggccaaggaaatgcgggcaagaagtagccatgcagttcagccaccctgggagaggctcctgggctctgaaaggctgccgggtagggaatgtggagggatggaacagcctgagaaagcctggacccagcgagctgcagtgccatctttcaccttctcccccagcctccctgcgaacctggaggaggatcggggcagagctggtcctggacagggctgcaggggccatcagcggtcggacatcctcttggggattagaaagacatacacgtccccttgtctcccacacccccagcctctgagggagaccacaggttttggcaggatggggtaggatgcgtgaagggaaggaaaggaactctaaaaacctcttctctccctgctgggtggcattcaagaagtaactcgtgtctcattcttcctcagctgaaagccacggacgcagatgagggcgagtttgggcgtgtgtggtaccgcatcctccatggtaagtggggctgccctaggatggggggcggtcctcctgcccaggggagggcagagcttctctaggctgccaaaggtctgggagatgaggccaagagaacccccagggccatatacatggggcgaggccagagggaggaaacagggacattctccttattcacaccaggtgggtgagggggaagcttttttgattatttgtttttgagacggagtctccctctgtcgcccaggctggagtgcagtggcgtgatctcggcctactgcaacctctgcctcctgggttcaagcgattctcctgcctcagcctcccgtccccagtagctcagtccccagtagctgggactacaggcgcatgcctgtaattttttgtgcttttagtagagacagggtttcaccgtgttagccaggatggccttgatctcctgaccttgtgatccacccatctcagccttccaaagtgctaggattacaggcgtgagccaccgtgcccctgggttggcttttgattgccgtgttcctgaagtcctgctgtcctgcagagcttcccaaagccatggccctgacagagagggcccagagcccagggcagcccccagcagcacgctccccagggactgggtctcattggtccaatcagaatccagtgcccatccctgaaccaatcgctatggccagagaataaaatgtgctgatcctcccacttctcgaatcaggggtaaagtcactgcccacaaatgttatggactgacagtagaggagagtagatccccaaagaaaaatcagggtgctgtgcccaaaagatgggggaatgagtgctggaccagccctgagatgtccactaaatcctggattcaaccacccatggagaatttggtttcagtccctctttttggagtgccccaggttcttctgaaatattaaaaaggcctcacactacccacatctgtgggtgtaggagcagggcgagggggaccagcaggagccccacctgctggggaccatcaacaccaagatgaaggctttcaggaaagagctgcaggccttcccggagcaggtgaaacgcattggggatggcctgtctgccttgccccacctcacagagtcctccagcttcctctccactgtgaattctgtgtcccagaagacccgcagcctcctcacaaggaggggactggtgaacttctgcccccaaccatggcaggccagcacagcaggagacttctgggcagggccggtgttccagggggtctgtccctccacacaggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgaggctaggggcgggctggggtgctgacctcaggacggggccaagcccacagctagaacagagaaggccattagttggcgcctggtgtgggcagggccaccactgatttaggtgctgaatgacatctgggcctaagggttcggtgacaggtgcccagcctgggacttggacttgtcattttgctgtgagtttgttcctccagctgtggaaaggagtcagtgatactgatgtctgtcctaagggatgaaagaggtgtccttactgtactaacccctgtatccacagagctctctagggtaagtcaaggaaatctcacttgggtgatcttggaggtacagatgctaacctcattttacagatgagaaaactgaggcacagagaagttgctagtgatagaatcaggactggagcccccatcttctgaatccaagttcagtgccctttccaatgaaagtgaccctaatatattccagtcacctctcccagctgcctcatcaaatgtattctttcctgcccagccttatctgtgcagccaaaatcaaatcagccttagtcctcccgaatggctgaaaacctacacacagatgttcccactggttgtgttatgtgtactaccgccagcagggggatgactgagatgaatgagatgacctctcaaggccgcttcacccccacccctacacactcagcagcccccagccccttcccctaaaccagtgagtcagaccccagacatcaggagtaggagggagatgggaagagtcaggcagagcaagcagggactttcacccagaactgagtgcccggctcctcttatcagccccatctccaccccctgcttcccccaggctggaaacaatgagcggtggtcaccgggtactcacgatcacaaacacgatgggtctgattgctcaggggctgtgctggggtgggtgactcagccctgacccagctcctgctgacacctccaacgctttgccccaagaagagctgggaagacacctgggtccttgcaactgccctgagtgagacctgccctgtggaaatggctgagagggtcagatcccctggttcttacagggccctggtgatggagactcagacacagtaacctggacatgcacatagccatgctggcttgcatgactgtgaatcttattcgtgggctggtcagtacgccctcatcagagcctgccttgtgtggggcctacttcagggcacagagtgactgatgtcagcgaagctggggttgggtctccagacttcaggcttcctaaccacagccctccatgtggccctcgctccccgctccctcacccaggcgtggtgggctcctgcctcctcccatcagtgcctcagcattgtggctgcaaacctcctttagccacaaaccttctgtatacacaaaatgatatgcagcatcccagggtacagtgtaaaacagatcgaagccagactgtgacaatcagtgcaggggtggggctcccagagccacacctgctcagctacttacgtcctgcccgtctcccctgaaccctgaggaataataaaccctcacacgtgcccgatatttttctaaatgcctcgtgtactttaacctccgtaaccctcataatagccttatgaagtaggcactgttaatacccccatcttacagatgacaagactgaggcaaagaggaattagccgacttgttcagggtcacacagcggtaagggtggagccaggcttcatgccttggcagccagcttgagcctgtccccttaaccactacactccactgcctcacataagcctcttcaaagcccagtcagaaaccactgcctcatccccacagggtaattttaaggtgagaatttgagggctggcccctggggcaggtgcttggtggcactgtagtacacagcctccacacccatgagacccgggagagctgggggccttcctgaaggcaatgtggggactctggctttccgctggactcattttcccagcagcaggggagagacggcttgcaggaaccatccacatcctccagttcctgcctcagagaccggggacagccccagtgaggggccggggagtacagagtgagacagtccccttagagactgggtgtctcagggtgttcacgacacatacacacacacacacgcacatatgcccacgcacacctcctctccctgtcctcctaaccactagcaccccattttgcagatgaggaaactgaggcaaagcactgcactggcacagcactggacaggcacagcactggacagaaagcaggtctggttctccaggaagcccagttgctcccacttgctcagcaagaacctgacagacctctgcttcctgtacatctgtgcctctcaggtttgcaaaccatcttgcctcctcctgtctctgctgctaaaaacaggctgaaaccgaccagaggctggtggcatgtagccagactcatggaggacaggccacaccccagctccctgccacctctctcatcttgtcattgtactgtcagcctggccctgttttttccccacaacccttggagtcaaggtcatttggacaagcagattgaggaagggtaaggcgcacagttttgcaagaggagtggttagtttctgtttaccgaaaaagagttcctgaaattcatccatgcaaactcccccccgcacccaccctacccaggatcttccccagccaagttctgggtgaagccaaatttaggttccagcctgtgaacagctgtgctctggagtggacatgttagtttgcatagtgggttctgggtgtctggacatgaaaattctaatgacacagcagagctttgggaaccctagaagcagcgatgcagagaaacttttacacccatatgcctctctgcccccagccctgccaccctccccaccccagagtcctccactggtcaggctgctgttttcggcttctaccagccagaagctctgtcacttctctccagctgattcccagctaatccccaaagagaaagcagggctgatcccagaggcagtgaccagatgccagacacacacgcctctgctgcacatgcagaggcccctcccttagtgctggtcaccacatgcaaagtctgtatggggcatcacagccccttccccatttgcttccctctctactttgctggcaagttcctaccggccccagctctgtttggctgggaagagggtgcctctcctgttctggggccagctcaccccagcatagagcaaagagctaaaagctaaaaactcctgggctccagcaatcctcccgcctcagcctccctagtagctgggattacagatgcatgtcaccacccccggctaattttttttagagacagagtctcattatgttgcccaggctggtctcaaactcctgggctcaagcgatcctcttgcctccgcctccctagtagctgggactacaggtgcgtgctatcacccctggctaatttttttttgtaatttttgtagagacagagtctcactatgttgcccaggctggtctcgaatgcctgggctcaagagatcctcccacttcaacctcccaaatttctgcgattacaggcaaaagccaccatgcctggcctccataaacaccttttaaactgtattacgttcatgatgtacagtgcacacattcataaagagaacttagtgctggtaagcggtgaggaaaatggtgcgtaattgcacaattcagaaacagccactgccttggatgggggcctcagaagcaaaccctgagacaaggattggtgtgaaagtaatgtgtaagaagcgcccacaggaaaaggtggaacagggtgcaaccagcaaggaaaaacagacagcaaagtgtcatggagggagctaggcctccgtcccccagggagccctaaagcgtcccctcactgccccaaacagggccagggaagctggagtctttgctctccacgcccatcaatcattggctcagggctgccctaggggacggaagttcccaggcatttctgctcactgggctggtttccaacagcccgggtgtgggtgcagtggggtggggttggtcttccccaaagagccttaggggctgggagctggccgtgagaaggtgcacaagtaaagagtactgagcactgacattctctactacaactgccattgtattttcacctctattttccaagatatattttaatatttgattgggatcactttgaattttttcaagaacttttgcaggccctggctcattttgtcttcataacaaccttaggagtggcatggagtgtgaactattttattattattaattttttttttttgagatggagtctcgctctgttgcccaggctggagtgcagtggcgcgatcttggttcactgcaacctctgcctcccgggttcacaccattctcctccctcagcctcctgagtagctgggactacaggcgcccgccaccacgcccggctaattttttgtatttttagtagagatggggtttcaccgtgttagccaggatggtctcgatcttctgacctcgtgatctgcccacctcggcctcccaaagtgctgctgggattacaggcgtgagccaccgcgcccggccgaattattatcttaatattaccactttatagctgggaaactgggggccccaaagagtcactaattagtcagatgttccacagcattagtcaaaaagccaagagcaagatgaagttcattccgaaacaagtaatgtttgagcacctgccacgcgccaggtgctgtgcaaggtggtggtcacagtgacccaccagacaggcctggggtcctagagggagctcacagcaggcccaggaaagcagtgaccacacaaggcggccacagtgggccaagccctgggcttcccagcctccaccccaccctgaccttgcacccctggcccggctcccacaggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggtgaggctggcaggaggaagccggggatcccattgctcagagcaaacctccccagctcacccagcccctccttcgaaacggtcatccctgatgcttcaggctccccatttagccatgtctaggccagggaggggctgctgggatggtcttgatcacttcccaccagtggccccagcctgagagggttggaatcagggagagttgtcccaaccactgggtggacagaggggaggccacaagcttgagaagtccagctccgtcatcccaggacccagcagctcccactagcctttagagaggggctgggcagagctgggaggggtaaagaggaccggtcagaaagctggctgcggcctggcctgctcctccagcccctccacgccttccaggaccagctcagggcctagcacacgcagaccccctgaccctgtacaaggggcagtacccttcctgtgccgcagggcagtagcctgaaggcagcctgaaccttgctgagggcccaagccccagaggcggccacagcccgcagtgcaaaatgaaggggaagcatgccgggtctctgtggccctccgtgcggcctgggctgtctggcctgtaccccagtcagggatacagctgaaaaggagcattttctggagacccactgtcccccagagaggctccctgagctgctcatccttcatgtcagctactctggtggctcccaactcctctctcagcatcctcagattatctgtggcatgcatgggatggggtggagggaggaatggctgcaaattctcaggcggaatctcaggcatgttaggagagtttagggcacatacgcggctgtggccccttgaggtctgtgaacttcagcttaggaatcccagctctagctcctgattgaatggtttgtttcaaggcacaggaatttggggcgtagggagtggggaggatgggggaaggtgtccctgacactgaagcccttctgtcgaagggaccaaaccaaggcttggccatctgtgaggatgcgttctagatcaaagcctccactacaagagatccttcatttcccccaatgcttgtatgtccagatatcaaagggaggtacatgagcttgaattttgaggctccaggagcagacccaactctttctgtcctatctctggtgccaaggccaagccccagaggaaggctcaacagtgcatgctggaccttgccatccacattgaccttaacacatcctctgctgcatctctgaggatgatcctgccggcagaggtggggcagcccatgctgggtgggccacccagggggtatgggtgtggcagcttgagaagccacagcgcagccccactcagttctatctgggactgcacagcctctgtgtcctcctacaggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacggtgaggggctgggggcagggagcaccatttcttccaatctaaccaacattggttgagctccttctgtgtgcacagcactctcctctttgtcataaaatgtccttgagatggccaagtgtggtgttaggtacctgtagtcccagctgcttgagaggctggggcaggaagattgcttcagctcaggagtttggaggctgcagtgagctgcgtttgcaccactgcactccagcccgggcaacagagtgagaccttgtctcttacaaagaaacaaaaaaaagtccccgagatcaatatccctgtaacacatccattttcatatgtaggagtaagataaagtttatacctatgcaggctggtatccttctgtttttccttctgttttcacacccatcacagatccttcacctctggtcatcgaagtgtgtgtggggttttcccccattatcggcaaccaattatctgactctcttgacaccagctgggaatcctatagtttgatttaattctgaacatttctacctggagttagcgtcagatcccacaggctcacagctcagtccctcccacacaccacgcaattctccagtagacaccatagtgtcagatcccacaggttgagggctcagtctcacaaaactgcctccacttcagctgccaatcacaacctctaggttgtttgacccatgcttctgaccaactggctaaatcagagttcccacaaccccctccacaagttcgatgaatttgctagagcagcttgcagaactcagggaaacactttacttactattaccaaagtattatgaaggatagtctaaaggataccaacaaacagctgaatgaagagacacacagagcaaggcatgggagaaggggcccagagcttcggtgccctcctcggacatgccaccctccaggcacccctacatgttcagcagactgcaagctctctgtagttcagggatgtctatggaggcttcatcacataggtacgatcaattattaactgaatctccagcctctgtcctcttcctggaaagtaaagggtgtagaggcagggctgaacatttcaagctgtttatcctggcttggtctttctggtgatcagccccaaccgaggaccccaccaagagttgcctcattagaacaaaagactcctatcacctaggaaatgccaggggattaagagctttgtgccaggaaccagggacagagaccaaatgcatatttcttatatcacaatgtcacagaaagctctgcaagtcatatttcccttttcaccttggctgttaggaagctcagacataaatgctgggcttcattgcaatagttattcttagctagttgtctggtacaccagtctcttatctactgccaggctcttactccttcgtctttgctttagtgtatcttttatcagaattccttctttgaaagtaggcaaggtgtgaatcactacaacgtgacaggccttgtcctagaggatactgggaacacaaatggacacaaagatgaacaagacccttctcagtcctcaaagagttctcaggctagaagtggaaatggaactaatccaggatgcaaatcagagcgccacaagaagatgtgcagagaactacaacagaggggtagtggagcccctcagggcccagcagtcatacctggctggggaagcaggaaggcttcatggaagaggtggcttcccagtggaatgtgagagagaagaaggaattcaacagacagagtgtcctggggaagttatgccggacagaggaagtgacatggaggtggaaaagtgggcagaatgaccagggttaacaagggtgcgatgttgtcactcacccatctggccccttccctgcagggtgtgatcacagtccagggcctggtggaccgtgagaagggcgacttctataccttgacagtggtggcagatgacggcggccccaaggtggactccaccgtggtgagtgggaccagggtgagagtccctcaggtgcggcccatcgctggccatgacacttcctaacccatgtcctcgccagccacccaatgtatgggccaggcagcgggcgagggtcttgatagcctgaggcttcgccatgtccagccatgccacaccttcccagcaggttgggctaggatgagacctcaggcaggtggagggtggcacctccagagacactgccgggagtggggtctggaagagccacagacggctaaccatttgcatctttgccttttctctcactcccctcctgctgctgcctctgcctacagaaggtgagtagcctgtggctggagcttcccctgtgctgttggctgtggccagtgctggccgggctctgcctggccctggaccttcccacctctcccagagagaaggcacgtggacaggcctgcagcaggccccctcccagtgcctccactctcacacctgagttcaggcccctctggggcatgtcccctgcctccaactctgtcctctgtgtcttgcctagccccggtagggtcttgggtggggagagtactagcaaaggagtcactggaagaccactgagggctcatcccagctccactcctcgatggctgtgtgacacaggcaagctgcttaacgtctctgtgcttcccttcctcgggtctaaaacgagggtcatgccagcatccctgccatcctcagaggatgagatggaagcagcaagagattgcaggcagaaagccctttgtaagccagtcctggaagcagatgtgactgcagtggggctctgtcctgatgcctcagctgctgcatccataaaggggaccccctccctctcctgggggttggtgcaagtgtgtggggtgggatgcacattgtggggcctgggagcgcttaggaaggggaccatgggcacaggttgtttctccctcaggacagcctctaagtaaaggcagagaagaccatgtgctgggcccctgggggaggggggcccactgaggtcagaagagccagacaacgttcctagaagaggcggcccggcctgaagggagaggcaggcaggggagctcatgctggggttgcaatgggagtgggtccagggccagctacctgagagaggtccatgggatggcatcctgtggtgatcccaggacactcagccatcaatctggcctggacactggccagtcacatcagctaccatctagagaccacctggggcatcaggctcctcatcagccttggttacagccacattgccacgccctgctgagtccctgtcacattaacctaaaaaagctagaagccaactcagtgtccaagccaagagccaaacacaatttcttggggttcttggccccaaggctccctggaggtgcccagttctagcggcactggttgtggctgggccatacctaaaggccccctccatccgtggggccagcctgggggtgagtgaggctgtgatgggcaagaagtctccacagctcccctcagctatgctccccaagggcagccggtgagcagagcgctcgggcagtgggtgccgagccacctgcgtcctgccactcccagccaaggggcagacactcaggggtaaagtgggaccctcttactgagcctcaccctcttcattcatacaatgggcccacctggccctcacacagcaggtgttgcgagaaggctgggaggagaggccagtgggagcccaagggtggcagggatggaaaggaggtccccctgcgtggactgccagccacttcctcagcacggctgttgagggcttcggagcacacacttctgcctgtgcccctgtatttccacagtgctttgccctcttccggttagcagggcccacccccttttgttctgccctggcttcctctgagaggctcccaggggccgctgccccagatccaccagccccggtagccccaaacactgtttgaggtgctagggtggaggcagaggaaggggccctttaaaggtggaaacatttcctctgctaggccggaacccaaaccacagctcacctccacctggctcctccctgtccccagcagccctggccggccccagaaggagtggtcaggcagaccagaaggggcaggctgggtagggcatggctctgctataagagctcttgagtaagttcaggccttcagggggtaggggagggcaatgtggattgtgaggccctgggtgaagacacagacacccatctcattcccataggcctgggaacctgtcctccttcctcacccactgaggccaacccccttccactgggaagtccagcagcccccctcacccctgccttgcagcctcaccaagatcagagcagtagtcattgtgggaacacctgctgtgtcccaggcactaggctgggttcaggttacagcaagaaaccaaaattagacatatcccttgccttcctaagtgtacgatacagtgagggaaagacattgatcaaatgatcacagcagtaaatgtatgccctgagagaaagcctataataaggtgtcagggaactagaagagggcttccctgaggaagggactcaagctgagagcgtcagaatgcatgagagttaacccagcctaaaaaggaagagcatttcgggcagagggaacggcaagcacaaaagccctgtggtgtgaggaaacacggtgagtctaaatgaggccttagctagagtgagggggtttgggagggatccgatcacaaggacccttgtctgttttcaccctgagaacagtgtgataggtattgtttttcccatttcaaatgggcggactggggctcagggacctcagggaactccatagcaaaactcatgacagatgggtagagtcttggcaagagaaatcatgaatgtctgccaggcaggaagcaggaacagggaagagtaggtgccaccccttcactttctgtttgctcagttattcctcccaacaggtgtcattctgattttcagctgaggaaatggaaaatcagagagcttgaataactttttccaaaatcgtgcagctcataagtggttgggttggcctagctgcgaagcccaggctcactctcctatacttctgagagctgcctacagataggggagtgtggctgggactgagcagtcaaacctgtatagaaggaagaatgacatggaatttcctctgcagcatgcacaggcttagccggctccccatgagtcctgtgcagagtcagcaggacctgggagcccctgaaccccacatgcagggaagcagagaatggggtctggcctggggcagggcagtgggagaaggcctgtcctgggatacctaaaacctgagctcctccaacccccctcacaccctcatcagtgaacccctgggtacctgtgattccagccgcagtggcctgtggccgtccgtggactggaggcctcacccgcggcaggccttcactctcctgcctctccacaagaagcccgagccacagacacaaaacaatatgctcttgcgtgccatttgttgcatgcccggtttttatttgacagtcagaaattcacatgccttccccatctgcccttctacccactggaaccaagccaccttgcagccccctcctgctcctgggcccatttccttccctctaagcccaaggttgcaaacaaagacaccttcgggcaatatctggccaccagatgtgttttggacagcccacacataatattcttctctaaattttattactcatcagccaatttcactttaaaatctagattccttatttttcatgaaaaacaggaagctttgctcatgctagaccagcattcctagcctccatccactttagccatggcctggcttttcagttctcctgtccccaccacctctgacagtctccccaccaggcctcttcccttgccctcctagccaagatttaagtgtgtctacctgccaccccacaccaatcagactgctaggagccatgggcccagggcctcctttgtaaagtcaggataggcttcggtgggctctgagggtttgctgatgttccagaacccactggggatctggtccctactggacccacggtgggacccaggtgtttggggccaaggaggggaaggaggctgtaggtctctgaccacgttcaccctcaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtgggccaccgagtgaaacagccaggatccaccatgtcagcggggctcccacagctctcacagctggaggggccttctgagccacccccatcaccaagcaccaggttcttccggtctctgcccctgcaatcacccagtctgtggtcagggagaagggacagagctgcctcagagctatgcaggccggtggccctgcctgggtcatgtggacatggagcccgaaggccagccaaggcgcaacccctcagtgaagttgttttccgggtaactccttcccacgcagccccagctccctgagaggacatgctcgtcctctctcctgcttcctaggcccagccccatggcaggaggcgcttgctgtcgctccaggtttggacaccccagagtgcagagggagaagtgatgaaacccgccagtgttcacacagctttcatctgttccgtgcattaggccgtgtgtttgcgggtgttagcatggcttgcatggtctagggggtcgagggatgctggctttggagacaaaagtgtgtaggttcagacctctggcatttgcaagctgtgtgaccttggctggttgttccatgtttctgagcctcctctctgtgaactgagaacagttgctttctgtcaaggttgccgtaagaaccaagtagagtccaggtaatgccgcagcgtgtgcccaccccagcagcgtgagcacaatcccctctaccctgggaagacgtcagtgccatgggactcaagccccactcttccaggccaggatactgatatctcctagccccggaactttccatgggtgctacactacctccatgggcctgcacccccattttgagggagatgaatcacttctgcttaaaacactgcactcccaaaagcccttgctcaacagagggcccacgtgggcagaggaggaccagggagtcccccttggcttgacctggccacctctcctccacacctgctcacccctcaccctctcttctccccacaggtggtcttctccctggcctctggcaacatcgcgggggcctttgagatcgtcaccaccaatgactccattggcgaagtgtttgtggccaggcccctggacagagaagagctggatcactacatcctccaggtggggcctggcctcccttggactgagagaccactggctaagtgcctagaccggtcactactctccatccaggagagagcctgtccatcagcacactctggtggtcagtgcccctgctgtcaccaagtaacatggggccagctgcacccatcggggccaagagcacagtgaggctgacccaggatagggaaacctgggagggaccttagatacccaggaggaggtagttgaggtgtcttcccctgctgtaagagccaggaggatgagggagagcctggtggagctgggagagccccagctcttctacaaatacagtgtggccttggacaggttattaactctgggcctcattttccccacctatgcaatgtacaaaaaaatccccgtctggcctgccctgtggagggaagaagcaagtgcaggcttgaggagccacgaaggctatcattattgcagaatggccatggctgggatgtttgccaagggctttctgggaacctcaggactgcgcttctgcagagggctcagctcctgcagcacttatgactgcatcaaggctcccaggaacaggctcagccatagggcgccagctcattgcttataatattacttgaggctcttttcccgtttgccagagatcatgggacagagtgcgtgggacagaggcctttgaagctaaagacaggagccttgggtcaggttgcaggcccagggtcatggtcaaaggctggcacagcccagaatacagtcagaggtaggtcaggaggtcaaggcttgggtacatgttaatcagattccaaacgaggatcccaagtcagacgacgattgggcaagaatcatttgcagcatggggcagaaggtgaaggctttggggagagcccagggctggccgggagagcccagggctggccaggccacccaggggttctcagtgagtctctttgccctcccaaatgctccccactgattgcacagcccttttggactccatattcccaatcctgcccgccacgctttagccctgactccagttgccctcctccttgcaggttgtggcttctgaccgaggcacccctccacggaagaaggaccacatcctgcaggtgaccatcctggacatcaatgacaaccctccagtcatcgagagcccctttggatacaatgtcagtgtgaatgaggtgagggcagccccggggcccatatagctggacatacggggggaccgtgggcacgagccaaccatgcagcccctgtttaaatgtctgcctggcccactggtccctcagatctcatggatgggaactgtggctcattcgtagtgatagccctaacgcctagcctggatcctagaatgcagtatctttttggagtagaggagaagagaaaagagaaaaagaagaaagttgcctttcaccagacaggaaactgaggtttaccccgggagcttgcttttttaaaaaatgtatttattattcagccctaagactgagccactccaatctgccctggcattgctgggtatcatgctaggttggacgttcatgaaggcaggatgacatgtggccagagtctagctctcaggccagactccctcacttcagcccactgattggctgtgtggacttgcacacattccttccctgcacctcagttttctcttctgtaaatgaggatgatgatgccagtacctaactcacagagttggagagaggacccagtgagttaatgcaggccccagcatatcagaggtgctcacagaatgttcgctgctatcatccttattatctccatcattgctctggggtagatgcagcaaagcttttgggaggtacagggggagccttcgggctacaggagcaggtgccagactgtgccccaatgccttgagtccagaatgactgctctcctgctctcctcccagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggtgagcgatgggggtggccacagggaggagcgggtgggccagggcagctccgcctccgagtgaggggaacaagatgggtgagaatggaattccacacagcaggcgaatccttgacaactcctttagtccatctgcctttagtccatctgcccaagatggcctccccttacggaggcctgttgcgtgcaaagctggggtgctagtttggcctcccgagtctatagctactcagaagctctgtttagtcctcttttctctcacagagcagctctatggggtggtacaggttgagcctctgtattggggcctggcccagggagcaagtgggtatgaatctagcccccgcttcacttgcccacctatgcactgtgaggtcacaccaatgtgcatggtggtgtcttacagaaagggtgcctctctggccctcttcccctacattgtgtggtgtggcatgctgtcacaacacgtcagggtgggaagggattcgtgtctgtggttcacactaacgctcgaatgaacagcaccactgcccaaggcaatgttcaaagtttgccaggtgagggaaggacttgtggtcctcaagggctggatggagatctctaggagctgatgagctgtgttgggagtggcttataaactgaaagcagggaatttggagtcaggagcactgtggctggctgcatgatcttgagcaagtcagaacctctcagcatatcgcttttgtcatctgcaaaagggagataatatctacctcataggtgttgtttggggaatcaaattagctcatgtctgtggaagcacttggtaaaccatgaggaggaagaggactgttattagttctctattgccacaataatgctgccttacaaaccaaacaaaacagaggagtaaaacaataaccacatagttagcgctaattctgcaggctggcaatctggacatggcttagccgggtggttcttctggtctcagctgggcttctgcatttgtatgtgggcagctgcctgtcagcagggtgctatgcttctgagggttggctcgccagcagctggggtgacagggacaactcatcctccagaaggctagcccgtgcctgttcttatggggctggaaagtgtccagaagagacagcagaggcgtgcaaggcctcttgagtccctggcttggaactggcacaaggtcacttctaccacaatctgttggccaaagcaagtcacaaggccagcccagactcaagctatgggaaaataaactctaccttctgaaggaatgagctacaaagtcacactgcaaagagtgtggttacaaggaaggtgaagagttcagggacagttttgtaatctgtctcctggaaggaccctgattgcaaatgaggccccagctctgtccctctcatagcaggttagacctctcccctttgacagcagcactgtgggaggtggggtcacaccaggtctgggcagggctctttgtctggagcttctctggagatgttggtccaataactccaggaattgggattgggttaataatccaggaatccccaccccaccacaacattctgaggagtccaggaaatgagactgactctgggcacccctgtgggcatccttagccccatggctgcacagtgtcatcactagccacctcagccattcacacccagtgggctaaacaaggatacatttataggacacgtgtcactcactgggcagggtggggctggggcagagaggggtatcatttattgtgttaacgtgggaggacccagtttcgacatgaccccaccccactgcacttggcttcagggtggatcatcttggtcgtcccttcaatagcatttgtgaagtaacagaaactgactatggagtcataaagaatcaaaatgcattttcctacagagcaaaaattctacagagaatgtggatttcaggctcagaggtgtcagagctcatgtttcttggcctttccctcatggtggcaagatagctactataactctaggcatcaagtcagcatccaaggcaggaagatgacaaaaagatggcaaagggctatggcagctacttctgcccttttatcaggaaagcaacaggtttcccagaaccaccctccagagtgctgcttgtgtctccttggccagaagtggctcacgtgggcaccctagctgcaagggaggttagaaaaaatgagggacaggattatcatggtcagcatattacttgggggccagatatatcacttcccacacaaaagcaggcctctgtcagtgaggaagaagtggagaatggatttggggtgggcatctgacagcatttgccacactgccctccccaatcctaatgcaggccagtcaacgcaccacccccactccccacccacactccaacccccacagtcctagggtctctcagggagaccatcggtggaatccataacattctaagaccctgcagtttgtaggcaaaatcaggcttcctttgggtccccagaataaatgggaattgaagaaatggaaaatcaccctggccacagttaatcacccagaatgcatgggccactatccaagcaatcctttaaaatcttgggattggtccccatggctaaaaagagtttccatctgctggccaaaccctctgcagggacccatcccaccccttggggagcataagcattcccacctcacatgtcagcccctgacattctggttctcactgaagcagggctcagcccataccagctccccggtgagagcaggagaagctgggtagcatccgccctgctcatcctggtcatcaccagctctgctccctgaggccccagaaaacaccctcaggatgattaggaccagggaccctgaggccatccatctccaggggaatatatatggggcttcctgggctgaaccatgatgctttcttccagaccgtaatataaacagcaacaggtaccaacttgaaagatgtataggaaaacaattttaagtcgaaaagaatccatccatcttcaatttttccccctgcttctccaagttgggaaaatattgctatcatttggtttttgcaggggacacctcagtgaagaattgcagtgaccatagggacatagagaaactagcactaaaccatatttattcattcattcactcattcactcattcactcattcattcattcagccattgtccctgaatggccactatgtgccaggcactggagataccgaaatgaagaaaatgtggtctgtggcctgaagaaatgaagttgagtaagggaggcaatgaaaacactggtgtgcaatggggcactgagaagggcttggggaaggcttcctggaggaggtgacacctgggccgagtcttgttggtcagtcttggttagcacagccaagaaagaagcatattctggggttcagcctgcacaaaggctgaagagcaagcaataatcagggatgggttctgggagccacaggtggtttaggcccggggctgcttccaaggccaagggcaggactctctatttccatatcctcccgggacagtgtatatgggactcgccataagagctgctcccgctgccttctcaagaccccccctctactgcctccatgcctggccgagccaaggtggggatggggcagagctagcaagcaggggtcctgcagcccacagtgcctaccagggtagcttgcctccaaggagcactggacccttgaagatttgcttccactgaccagaccctcaactttgggcagtaaacccctcagggttatgaatatccccaagagcagagcccttctctgcctctgggcagatttcactggatgcgtgtatgaggaaggagcattgtcccagcccctcctagagcaaccagagacctgagcagcatgcagccaaccaccctgagattccaggaatggctgccacagtctaatgggtgagacagcagctgctaccctgcatagatccatccagagaaagccagcaggcccacttgccatccttttactcccactgcagttatctgcctggcttcaaaatggccttcactggctcaggaccaaccttgctggaggacaagggcatgaaagattcattcatttgttcatccaacaccaagtatgtgttatgtgtgaggcctgtagtacaggctaggacaccagagatacatcaggcacaggtctgccctccaggagcctacggtctggcaggggaaggcacatgtactggagagctgacactgtgatgtggtagagtgctaggagcctggaagccagggcaggttttctggaggaagcatcatttgcatccctgttttgaaagatgtggctccctaagcagggggcctgagatttggctgctaagaccctccccagagccaagagaaattctctgagtccctccagctctacttttctccctgagaccctcgtccccccaggttcctgagagctggacattcctgcaaacagcctaggccacccccatccggcctcagcccatatcacccgaactcggaacagctgtgctgcaaggggtatctgggccagacccaggcccgccacacaatggtgtgccactggccgggggagtcattgtggagcctcagcccctgcctagctccaggccatgggaagacaggccaggcttgggggaggggtttaagtggttgtcagggaggcccctgcaaaggaagagctgggcccagggaggaagggcggaaggtaactgggaggtcaggagttagcccaacctcagaggcacttggcagtggggtggagagggagggagggcctaactgtggcctccctgccacgtgaattgcagccaaccgatactactattccagataagaagccctggcttctcaggctggtgaggacctgcagaagtcacctatccaggcagaaggacagaaatctcccaccgcccccttctggtatgcaagtccccagcagcggccccgtgacggtctatgagctggggacactgctcttggcagtacacctcatgtctttagagcagaggccccttctgtttattagacttggaccctgctattgtgaactctgcttcccctggcttgagatcagaaggtcccagcctggccctcaccctctgtggcaccaagaaggctggccttccctgacccagcacaagtacatccagacccttcccttggcctggcttcttgagggatgttccacagctgcccagatgctccacatacaactggctaagttcctccaagagaccctggggctcagctgctgagggtttctcccttccccatcccctaatgcaagcaagaggggtgcatgggccactgtgcctatcaggagtcctctagctccacagttggcaggcagaaaagggagtggcaggagctgatatggaaggagcctacccatcagcagcagcgtcttctggacccagaagaaggcccaggccagggcaggcagagcacagataggaacgtttctggtgtgcagtacagtggagccctggacctgtgggcacaagttcatctcccagagcccttgtatgtgctctaagcaagtccaaggtgaaggccaagccaggccctggcccataataccaatccattcagtgaggaggaagcaggagacccagggtttagtcgtagttccaccgtttacttgttttgacaagacacagacctttcagaacctctattgccctctgtgttaaatggcagcaataaaacctcccaggattttcagggaagggggtggatcaaacaagttacaacacatgtgaaagtgtgttggaaagcaccaagtattctaacagaaaaggccaagaaacagcatgcatgctgccacttccctctcccgtgcccaaggcagacatggctatctatctcggcactgtctcaccaagctatattgatcattcagaatccctctcaacacattccaggatagttagggtgacatagcctccatggggtgaagagaagcagcaatgcaaagcagggaatgcccagggaatgggccaggtggcctgtgccgtctatgggctgggcctcatgctcagctgggctgtggctgggcttcaagaggcctttgttcccagcatcctggttagcaaccccagttcctctttcgtgcattgtggttccctgagaaaacgttaacccagcccccagcacagtcaggccagccctggggaaggcctcattcatgaggcaggaccccaggggccaagttggtgctcggtggtggcaggacccctgcagccccctgtcccactgcacactcccaagtccaccccgcgaggagcaccccctgaaaaaggccatgtatcagcccctctgccctgggccactgcatgtagtgggagctctggtcaggcagaagtcttttgaaaagcaggtcctggggctcctgcacctccaccccagcgcccatcgccacggactcccccaggcagggccagcctgcccaccagcagtcaccagtggcctccatggtgtgtttttagggagtgctgagcagtccccgctgtgtcagcaaaaccctccaaatggtgctttcaattccattccttcagcctctccctgggagggaataaaggcaggaagtctctattaaactgtgaatgtcaggagataggtaagatggcccctaattcctgattgatctcctaacaatgaattagttcttaaaagcatggatttccctctcagggcctcagactgtgccacgaatccagcgctccaggagcctcctgccccagcccctagtgctcctcccgccccctggaggcgccatgttctcgcacccagctctcccatgcaccccagcccacagccaccagggctggcatcagaggcactaccatcccgggcaactcagagggcggctccagcagcctgcccctccccagcagcagcagggagggacgtccctagtgcgttgtaggcagggcctgtggccatggatgaagatggaactgggagctcagagtaaatttcgctgaaaacaggaaaccacgaagcccagatgcgttcagttgtaaaagggtccagagaagagagggcagggccgcaccagaggaagctgaggaggaagtgcggtggctgttctgctgcgggccgcctccctctccacacagcagcagccaggcctggggtctggcagccaaattcttagaagttgtctctgcctcaaggtcagcagctgagggctggggccaggccagcctccccagagggcagggcatgctcttcctgagttgggagaaccggaatctgggctgtgggcttgtccttcgactccaggaacagcaggtgtcctgtccccactcctgccatgcaggcccccatgaattgtgaaaaacataccctctttccttctttctttctttttaaaatttgttttgaggcaaagttttgctccgtccccaggctggagtgtagtggctcgaacacagctcacagcagccttgaacacctgggcttaagcggtccttccacctcagccctgcaaagtgctgggaggacaggtgtgtgccaccatggccagccagcaccctcttcctatggcagctggcatcaagcattgtggtgaccagagggaacaaaagaagggacccccctctgcctagggacaagggagaagccggggtttgggcatattctggccactcgaggtgtcagccccatctccgggcctatgtttaccctctcctcaaagcccctggcccagcccaggcagagcaggaggccctcagtggaccattcctttgggcctaactggggggcttagaagcagggccatgtgtccaggtggggttccctggctgtagccacaggcccagggctcactgctgccaggcagcctagaggtgctccccttttccatccccccaaccccccaagcaattgggcgaacatcttcccgcctagccccaaatcctggctttcagcacccaggcccagctcagcagagccagtgtaggctgctaggagacaaatgcccaggctggactatgctctccacagtacctggggcccccatcctgctaaacgctacagggggtctgcccagccccacctcacctgtccccatgctcaggcactgccttccctgttttacccccagagtgtacagagatgccccctactctcctcccctgctttaaaatccttcaatcacaattccacagaggactcaccttgcctatgtgtataaaaacaaagccagggcatgcccacaagcaggagatgggaacatcacccgcacctggccgaatggctctgaagcgaagactccaccaggcccagattgtatggagtggaaggtgggggtgggggaggagcagcagagtgcagatttaaactggctcttacaatccatctccagggtttgcacctgtttccccatgtagtttttaatagcatcccgcttcatactcagaagtgtcccagggtggacaagacattgtgtggcacccttgcaatggcccgcgctgagcagtgggagtaggggatggggagggcggggggcaggtgcccctctccactcaccttcccagaaggccccacccacctccctcagcaccatctccagtgggtggggcaacatctgtcctggcctcagattgcccaagacaccatttgctcacggaggccaccatgccccaatatgtacttcccgtttcgggaccaccaagctctggggactggaatgcaggcagtggaagccccagattgacttaacctgttgacagatcttcagagaaactgctggtaggaggcagctggggaaggtggcgatggccagtgggcaggcaggcctggccccagagccactgtggtacaaagaggaagtctgacagaagagcagcctcgggcaaaacgggggagccaaggcggccacgggggagaagtctctccaccgtgccctgtgtctggtgcctgggagggtggcccagtgtccatcttgtcccactgatgctgccacatcccaaggctcatgtctcagaacgagagctgctgaagggctggacgttctgagacttcttaagatgtaagtcatttggcatctgtagctggtgaatttcaggtctctaggggagaatctcagcaccccaaaatccttggaacaggggctgagccgtccagcatccccatgtagcatccagaggggttgaggggctgggcttctgggatgtcacagtatctgagcccagagcaggagggagggaaccagggccgaggccaaggaggccactcacagagccagccctggctcaaatgcacctgccccagacccagccacaacagcccactgtcccccagctgggctagatgacctcaaagtttggagagtcagggacagggtctgcaagaaaaggagaagcaaagtgaacggggcccctctgcccctcaccctcaaccccaccccgtgaggccgtggaactcttcagggaggtgaatgggggcccctctgtccctcaccctcaaccccaccccgtgaggccgtggaactcttcagggaggtgaatgggggcccctctgtccctcaccctcaaccccaccccgtgaggccgtggaactcttcagggaggtgaatgggggcccctctgtccctcaccctcaaccccaccccgtgaggccgtggaactcttcagggagggcagggagtgaggccgatgccctgcaggccatgaggtcatgaccttacaggtcatcgtgctgtgaaggtcaggaaacacttacccagggatgggaagaagacgtctccggggcctggaggagacaggggggtgctgggctccgaaagcagatgccgcccagactcagaaggctgccgctgggccacataggacagggggtgcctgactttggcctcgggtatcccctgggcaggtggtgaggcttcaaagccggggttttcaatcccttgaatgttgctgccacagaaccagaatggaaggtcatctgtgctgtccggagcgtgaactctgccctccctgcccccagtttttctctcctccctttctctcacctacatccccatccccaagcctcagcagcatctccaagcaagaaggcaggagccaggcccacagagcaaaggccatgggctgcacctgcccacctgtcctgagctgagggcatcagggcccaccagaacagaccccagctcctccctgtggtctgaccatcaaccccgggcacagccaggaagccaaaaatcacagacacttctagaacttcagcctcaggaatttggggacaagtttctctttggtcaatagagttgatggcattaggatcgaacatccccaaagcctgtcttgagctgaggggaggggttctcttctcttcccagttgggagtgggataacttctgaagacccctgcaactcttagattctagatgagttgcaagcaggacttccttcaacctgtcttgaagatcatccctttcaaacacctagaggagctttgtgtttggtgttgcaggtaccggggcaggaacttgggttccctgaacacaccctccaggccaggctgcatggcagcttcctgcccagagcacaccaatacacagtccccatcccctctgcccctagacccagcccactgcaccactctgggacccctcagcctctgcccttgtggcctgcagcggcctaacagctttctccttggagttctctgcgggcaggaggcacagctcaagggctgtggctggggctgggcccgctggcctcctttgcatgtctcactgtctgccccagacagtgcttcctccctgtccccatcctggcccaggctgaccactgagacccgaaggtgggtgcatgacacatctgagcagaatcagagctcagcctgctgagtcggggtggcaggagaacagccaatctgcacagatgtgcaggcttcagcagcagatggcagaggctcttctgaccagctgctctaggcagctaaacagggcccctactgcacagaagtatctcttcctggatagccggcccaggaagttttctcaagaaggtctccatgggccttacctgtccatccgcaccagctcctgggcacctagggacagacagacagagaagctggtcatggaagggaaggcttccccatacaacatccctgcccctgctggcagatgccctgcagggaacaggagcgagcccaggagggccctgcacagctccggactccatttcttttcacatgggtgctgtccagcaagcgatctgcgtgtctgtccagcagatggggcctccatgaggggcccattttgacgactgataaatgaaactctatctgcattttccaggagtgtaagaacgctatctgccatcaggagaccaa

SEQ ID NO: 192 - DNA, 4689 bp, Homo sapiens
  cDNA C10orf54-001
ccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggactgctcagcactccctaaaaacacaccatggaggccactggtgactgctggtgggcaggctggccctgcctgggggagtccgtggcgatgggcgctggggtggaggtgcaggagccccaggacctgcttttcaaaagacttctgcctgaccagagctcccactacatgcagtggcccagggcagaggggctgatacatggcctttttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccatggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgact

SEQ ID NO: 193 - DNA, 758 bp, Homo sapiens
  cDNA C10orf54-003
gctacctctgccagcgcctgatcaccttcccaggataagcctggctctggatgacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagcct

SEQ ID NO: 194 - DNA, 790 bp, Homo sapiens
  cDNA C10orf54-002
gctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaagtaagggaccaacctcttgccccttttgggttctctgttttcttctgtcctcatcctgcacccagaccctgtttggaactctggcctcatcaccccaagccctcagaaccccccggtcctcctccttttctgctgctgcacatcccttctgcttcctccttggtgcaatccccagaagcccactctccttccatctgctctggagtctctgctcctcttgactctctggagtggctgtgccttggcagtgacctttggccagggcaagtgcctcatgacaggtactgggtgccccaggcagctaagtgccgccctgcccaccagccccctatggcttgggaaggctgggggtcctcttggcctagaattaaactacttcagatttc

SEQ ID NO: 195 - DNA, 2822 bp, Homo sapiens
  1st Promoter of HHLA2
cacatatagaactggatgcccttgtggtacatctcaaggctgatttgaaagcttgagagaccatcaagaattggatttggggaagaggtgagtatttgctatactatattttactctatgtgtataaattccttgaacagaaaaattttaatacaacatttaaaagacatattcagtcatcatctttagcacaaatgaagttttggcaaatgtatgcagatattcctacacaaaaatactatttcttgcacaagaaatagtattaccattcaccaaaatgcactataaatctggtagagggttgtaacttatagaccttccatgttgttttaaagaaatatagaattaagaacatttacagaaatctgttgtttctcactttaccaagtgtaaataggggtatgtgtctgtatctagcatatgtacttaggaaattgttctactcataacaaacctatggtcttttatcagcggtgtgatttgcaagtagtagagaacaacacctgggaagcttgtctttctgtgttttctaataagcctgtaatcattttgttaagccccttgggatggccttggtctaaactgcctcttgagtaatcccaagtactgacacaactttgcaaataataatcaaagacacatgtaaatatgccaactaaatttggacctatgtttaatgcttacttatgttatttagtgcacagtgaaatatttaaagtgatggctaacattttgaaaacatcaagtaatatcaaacattaagtattatttacccagatataagaaggagaaaatggaaattcaagtgagaggagcatcatggtaaatcagtctgtgccaaaattatgaatgaaatggagctgcattcttgatactaccttcaaaaatcctccaacttttctagagccaagctctagaaaaagcttatccctttttctagatttaagattgggtattgggcacaagaaaggagtgtagctttcaaggttggtcttttccatagttgagaactagaaactgagctagagaaatcatacatggtatatacacatttgattgcagtaactagggcctgacatagatttgattacttctattttaatctcaagagatgtctatgtccccaaactagtttactctacatcatagcagagaaaatggacaaaacacagctgttttggtaagtatataactcacttggtatgaacagaattgtgcagatgtactgcagcggtgtgtcagtgtctgcttatcagttcttgttctcttttctgcccttcctcactctgctatgtgccacattgcaagaaaccacatttcccagactgcctttccctctggcttctgtgtatgtccagccaatggcaggcacaggcggaaaacgggagggctggaggagaggggagggaagaagccacgttccccccattcaccattcttacttcctgaggtgtcctgccagaggctgcctctcttctgcatcctcttagtggctctaatccccccagacggtccagactctcaccagttccttcttctgttatccctccagccttatgggttatagcagcttcttgttactgctaatttctggattgcctcactcacccctattgcttcccagccatcacccatgtggccaattttctgtaagataataaatttcttctttatcaaaaacctgtggtgtttctgctccctggctggaccttgcagactactagctatgtcaagggacagggaaaagtatgaacagtagggcctgttgatgtcctgcccagatccccttttctaggcaggtgcacccaaactccagctgctgtgagtgctggctgctaatggcctttgtatacactcttccagagatttacctttgcccagagatgcctgggaagctatgatgtttccccgggggtggcccatgcccaatgacaggctgatttgaggacaagctggccccttgcagcaagggtgagcaagtctgtggtgccactcaggttccagtgctcctgatgctatgagatagagaccagacctcagccaagctcattttttgcttggcttcttccctttctctgtcctacttccttgattccttacaattttctcctgaaagctcaccctcagtaattccactgcatgataatcaccatttctggctctgcctcaagggaacctgaactaagagtatattttacagagggaatggagaaaatctgtttaatctggtgagatggtgaaatggaggttgtgaacagagcttcaatgtagtgatgatgaaactaaaaaaacacaacagctgaacattcttgaggaacgaacagttgtgggaggactcaacattttgaaattaaggagaaaagtggtgccttgccaaaattaaggtctggagaggctagttttcatggcaaaaggatgatactgtacttctgaccagtgtaatatggcattccaagagttttcaagagtatcaatacctgtggggtagttagaaatgcaagtctgttttaagactagaaatatatattctgtgagataattatataaagacagtttttctcaggcttgagtcatgcacaattctttattttggaaaaaggctggtgtgggtagtcttgtaccaacgagcaggattgtgattcgggggagtgaaaccagcagtgagggaaggtcaacacagatgtgttactgattggatcccaaccattgggaactatgcttaatcccgggggattttctggagaacattagtaaatatgtttcagaaccactcaacaagggcaaggagtgggagcatttattcatcctctccagggccccca

SEQ ID NO: 196 - DNA, 11599 bp, Homo sapiens
  2nd Promoter of HHLA2
acgcctggctaatttttgtatttttggtagagaaggagtttcaccatgttggccaggctggtgtcgaactgctgacctcaggtaatccgcccgcctcggcctcccaaaatgctgggattacagggatgagccaccacgcccagcctcaaactcttttcttgtataaaagaaaattcccacatttgcaagataatgcttcagttaatagtattttccttttaatgttgacataaaaataaataggaatttttaagttaatgtggtttttctgtcagaaaactcctataaaaaccataaggcacattaaacttactacaaacttctaatggctcataactaacgtttgttttagcttcaagattaaaagtgtttttgctaccattactaagcaaatgtgtgtctcttacattttacattactctgttaaaatataacacatcttctttcaacattttgttgtgaaaggagacatttgtttttcattgatttatttaaacaaacaaaaaaaaacagagcccagttcttgtgtcagtagctcttcatcccttagttttcttaattaattatcttcattatgcgttactttcaaatgtttggagacatttgaaaatccaactcacagtagtttaaatgtattacttaattaacaggaagactagaggtagaggactcagcacagacaggagcagagactcaacagtgtcatcacaaacccagcttctttccatccatctgctctgtcatccttgttactgtgacttcttaatccccctacttgtttcctcacaactgtaagatagaagctccagctccagacatcaaatcaatgctctgaaagtagagggacggggtttgccatcatgttctgctcttgcatccaatttagaggctctcacttccatcccaagccggacatgctcatctcatttacctttctgaacaatttgtcagttcttttcaatagaggcagtcgcgtcctgcaacacagcttgacagaggagttgttagcaaggaaggagggaaatggtactggtgtctgtcacagtgtccttccaaatttaatcatatcctactaaagtcttcttttaatggtattctattacatttagctagttgatgcttatcggctggctcctttttcttctttctctctttttttttttttttttttttgagatggagttttactctcgtcacccaggctggagtgcaacggcgcgctctcagcttactgcaacctccgacttccaggttcaagtgattctcctgcctcagcctcctgagtagctgggattacaggtgcctaccacaatgcctggcttattttttgtatttttagtagagacagggtttcgccatgttgaccaggctggcctcgaactcctgacctcagatgatccacccacctctgcctcccaaagtgctgggattacaggcatgagccactgcgcctggcctggctccttttactcaaccactgtaatcccactggtgtgatctttctaaaacacaatctgacttcatcattagctttctagtatggcttaaaataatggtcatgctgtacccctgggacatctttccagcattttctcttccatgtggactgctgggtattattataatcgcataggatttatgttctctcttgctgctgcatctttgttctattgtctgtccagaataaccttctactcttccttataggccagtgtctctttgtacctcaaacctaatgctttgagaggtcttccttaacaccctgccccttccaagctcaagcgtctttcctgtttccttccacagcacctggtgggagcccttcttcctgcctgcatctctgtattatgatttgtttatgtaattcacctatcttttggtaccagatggagctttctgagattagggactgactcatccctgtacagtttgtgacccgtaggtgatgctgaaatcatatatttttaatggcagcaaggatgttaaaactttctggatgacagtgtggggtaccatacaaagaatgacctagtcctgtttcctaggaggtcaagataagttggagggcattttattttttcttgtttctcagaacttgaacctttcctggctctaacttacgtatggattatgagtagaagacaaggcttctgaagcaatgaagctttacaaaccaaagttatttggaagaattgactctgagcaccaaaaactcactggtacaaagccagcatgataaccactgtacttaggaaatgactcactgaactgcatacatagaactaggccaggagattttcttttcttgtgtaccagctagtcaggttagcaaccgctttaaattctgaggactgatagccactaattcagatgtacataggtgcaagtacttgatagaaagcagtctattttaaagtatcacttaataaaagctctaagcagtctatgcaggtaggagtaagtcttataaagattggatttgcctattcttcacaccaattccttgattctgatattcagttacaggtcacccgccccagcaccttgatatgtagatacaagtaggcgttctttactttgggatatgaaaagatgacaaagggattgagtgggaatgattaacctcatactggggaatgacgattgctggatatatcacttaccacacaatagatgtatttaaatgtaacagctgtaaccagcataggatggaattctgatatcaggagtaggtgataaacttaaattgacattggaaaagaagtttccagcttcgtaattcagttagtccagatgttttgaccccacagactgttgatcctcctcaatgttacagaaacttggtcccagattatgtgtgttgagagttcactgtatcattgtagagctttcattacttcagtggaagtccttacatctgacataatcagatgtgtctagttaaaaactagttagtctagctaagaaaaagttattcaaattatacactttgaatgttttaaacctaaacataaaagtccactcattttctagtcttttgggaaaaacagtcaaagccttgtcctgagtatggtgccactgtttgattttttttttcctgtatccatagaacaatttaatcaataatgcattattcagtatttccagtttttgtttcttaaaaatggccagagacctttgcattcaaatatgtacaaaaaagtccagttcctcctaggctctacaattggctttgaatcttttgccattgtctctcccacacctaatacaataactgattttttttcatctttgttgtgacttgcttttatttagcttttccaaagcattcatcttattcaattagtcattgaagatagaccaggtttggtcttgtcctcccatttaatcaattaacataacattttgttaaattatttgatgataacccactgaactgcagggggtagaagtgtacagaaagagtgcactggctttccagaagcacttggtgtgccatgggcatctagcaatatgttttacagagaaaaaggtgactaagaagtccttggcctcacatgtgcacatgttcaacactaactttatttaatggagttttgttcaattgctcactaccttgatgtattcgacaaaatgcctgctgtctgccgtgttaaccctggcaatttcttttgtctgttttcttggctttgcagcattcttgctaaacaacaacaacaacaacaaaaccccactctgtctagctatattctttctgatatagagagctattaaggaggattatattatctacccatttgacaagaagaaacatttcgtgattgaaggctgagctggaaaatggtccctggaagcaggagtagttccctggactttaccccaccttgtgtaatgtggattcctattcaagtgcttcatcctgggctctgcttccagggaaccaacccctcccaagatggggaattgagggcaagtaaagagagcagtgttctcattaactgtatgaaagctgtaaggaagattgagaaggaggatgacacagagaaagatgctaagaaaaaaatgtggcttcaggtgaaggctcagcctgaacccaagggagctctgggctacaggatgtttcttgccttgaagccaccactggggcagggagttgcaaagcaacataacctgagaactgcagcttccatcatccaagtacaatcctccaaagaaggctgaagttatgtgagcaggtagcagcagctaagcaacacatgtgtgaaaactaaattgataaaagcagtaaaaggggatctttgtaggtgattaactgcaaattcacagaatatcagatagtaaatgtgtggtattgttaaaataactacttttattggacccaatttacgagcctccctaaattttctgggtttctcttgtctcttgggccctcaactggttagacaaaaagagaccagccccaatttccaaatgtcaccagctgacccgtctcctctgggaaagccaacttcaacatgtcctctattatgccttcctccttgggaagtgcagcagctgcagaatccagacatgacccaaggaaacacacagactgcggtttcacctttcacctgtttccagactcaaacacaaagcatcatacagttaaaatgccacacagtaaggcatggcatttggctttcgtagtgcttttcccaaggggccataggcacaaccaggaagagcataggagctaatgccaatggggaaaactttaaccactggggggcaacttatagataaattcctttttgctctcttcctctgatggattgttttgagctgctgtggttctgtggagcatgtctagagattgtcccttgtgactgagcaggtggctctattttccattctgaatctgtggctggcaaagcaagcaccacctagtatctgttttccattcttccttgtttcacttccccttttccctcactcttcctgccctgcaattgcacctcctcacctcccccaaaacgttagcacataatcttagcttgatttccaaaatcaaaaataaaaacacaccaaaacagaaccgaaggcaaagacagcacccctagagatcaaagtttcagtacatgtacaaatcccctaaatggtgggatttcactgtgaaacatcaggagagatattttgagtaaagagagggtaatcctgaaattgttcttttgttctttttctgtctaaacagtcaatcttattaaaatctaagtggatgctaaggaacatccccaggatgctacaaagagttttcctttgttaagacgtcttttacaaactagctcggtgtcatgagcactgtggtgaggcacagaaagtaaaaacaatgcagaggagaatgtagcaacctagaagctgcttttcctcaaaggagtgcagaacattcatgaactggcataatgatgagagtgatgcaaaacattcttatgtttcaaaaaagagaattgacctgttcttgtggctctggtcagattgagaccagcagttatgaggccaggactagtcttttaaaaaatatattgacagataacattatatgtttttatcgtgtacaacatgatattgtgaagtacacatacattgtgaaatggttttgagcgttactaatgtgcaggctagagaatctgtcccaactgcaagtgatgtttgcatcatcatgtcacaattagtactgatggctgtggtcaatttagtctggagctattaagatgggtatgggggagctgttctgttttcgctattttatgcttgtagaaatggcctcaattttctcttctgtctgattagtcttagcatatggatttcttttttgccatattctattgcagaggctgcctctctctgcctttctccctcacatctggaatccagccaaaagtaccagaacaagatgcttctcacatttgggcccttttgtaagggtgctgattgcaacttgggcaacttcagtataatctaaggtggaagctttctgctgcttttggggaaaaaaataagtgtctaaaaataaaacctaggcataaaaatagggccaaatactcattaactgcctcacttagctgaatgctgaaattatttcaacagcactaaatcaagcctttgtgtagaagaggttgggcatttttttattcataatactttatcttagatgataaatgggttactgtaatttctcactttattcaaaacatgaattaaatagtcctcagagactcaatttttggctcatgctcatgctgacccttgaattggagcacttgtgttcacaagtctccaggaatgtattttgtgggctgctgtgggaaaggattgggggacagacaggaccaggagtggtggattaaaggcttgggatgctagggttaagaatttggatcttacattaggtgtggtgggaagccactggagggatttaattaggagaatattatagaatgacttctttttttaaaaaatatgactcctgactgctgtattgacagtggattggaaggagacaacagtaggaaaagggtaaccagccgaatgcgtatttgtagatatccaggtaagaagggatagtggctttggagcaggatggtaatggtagagttggagagtaggcaaataatggagtttatctaattcattaacaacaacaaaaagattggttaatagattagatatggggcataagagaatggaagagtcaagattgatttctaagtttctgacccaaacaactggaagaatttggtactaggtgagatgaagactggagaaagaacaggatagtttctgctgttttgttgtgtttggggtgggtcatagagaaatggaaaaggaaatgaggtggaaatggctcatgttaacttagggaatctaaatgaacagttcagaagaatagttaaacatatgaccttgatccagtagataagtttgagaatccttgatgtacagattatattcagagtgtgagatgaactcgcctaaggagagaatagagagaaagtagaaaacctggtaacattccatatttccacataaatagggcaagcagaagagaaccagtaaaggacttagaaggaacagcagtaaggaaagaaaaactaggagagtatgatgttccagaaaccaagagaagactcttaacaaaggcaggtaacagtcaattacattaaatgctgctacgaggttgagttagatgaggacaaataatatcactgtttttggtgttcttggtaatactgacaagggcagtttatgacatgtcatgcagaaaagagccgagagttggtaggacattttaaagtgggaaatgaagacagctatttagacaattatttcaagaaattaatggagctgagaaatagataatcaagagtaaggggagaattttttgttttttctcatgtttctaagatgggtgattggagcttttatgcctatagaattgattcaggagagagagagagatcctgatgatgtagtagaaaggaaatatgattgcagggacaaatttcttttttttttttaattatactttaaattctgggttacatgtgcagaacatgcagttttgttacataggtatacaggtgccctggtggtttgctgcacccatcaacccgtcacctacattaggtatttatcctaatgttatccctcccctagccccccaccccctgacaggccccggtgtgtgatgttcccctccctgtgtccatgttccactcccacttatgagtgagaacatgcagcgtttggttttctgatcttgtgatagtttcctgagaatgatggtttccagcttcatccatgtccctgcaaaggacatgaactcatccttttttatggccgcatagtattccatggtgtatatgtgccacattttctttatacagtctatcattgatggacatttgggttggttccaagtcaaaattaaaagaactagagaagcaacagcaaacaaattcaaaagctagcagaagacatgaaataactaagatcagagaagaactgaaggaggtagaggaacaaaaaacccttcaaaaaatcaatgaatccaagagctgttttttttaaaaaaaaaaatcaacaaaatagatagaccactagccagactaataaagaagaaaagagagaagaatcaaatagacacaataaaaaatgataaagagggtatcagcactgatcccacagaaatacaaactaccatcagataatactataaacacctctacgcaaataaactagaaaatctagaagaaatggataaattcctggacacatacaccctcccaagtctaagccaggaagaagtcaaatccctgaatagaccaataacaagttctgaaattgaggcagtaattaatagcctaccaaccaaaaaaagtccaggaccagatggattcacagccaaattctaccagaggtacaaagaggagctggtaccattccttctgaaatgattccaaacaatagaaaaagagggaatcctccctaactcattttatgggacaaatttcttgaatacagaaaggtgtgagatgcagagtacagtgaagggtttggccttggataagagcagaaggagagacaaaaagagtgcacctagatgttaatgggttggttgagtcagtgataggaggatgagggagtagccataatcagttacaacaattatgaagtaagagcatcagctggaaaagagatgagaacagggaatgtcagtttcaagagaaggtagcaaatattggagtcattctaggcaatgggaagatgaacctctagcaagacaatggacatggaatgtttcagggttacgttaaacaaggtgaatttgagttaatttttgcttggaaagagacagtaattaaatttcaaggttttttttaatggcatatagaggcaaaaggtattattacatgtttacatattttcatagtagaaaaatgagtttaatgattacttgtaatcttactcttccaaaataatcattgtgatatccttttatatattatacatgcaaatacttccataggaagaaatataaaggtctcaattttgataactaatactattttggagcagttttgactttaccaactatcttagttattgctctaagagaaataaaagcaattggactcataactttgtcatattgcaaaagtatttctatattttgttgctttttccatttttatagagataatagaaaatgtacagttttgttaaaaggccttcttcctaaggtcgtgttttcaataactttcttatagtctttaaaatgtaaaaatgaaactctaaattattaatctaccaggttttattttgataagatgtgatgaaggaatctaattttacttttttaaaaaaattgttattttaacaggagttacatgtgcaggcttgttacatgggtatattgcatgattaatttcacttcttaaaatagtttcaagtcattcttaaatcacatacctcacaacaaatatagaatatattcttgtaatagtagagctcctaaatggtatcttttttatttattttattttattgttacttttttgagacagagtctcactgtcttgcccaggctggagtgcagtggtacaatctcgcctcactgcaacctccacctccctggttcaagcaatttgcctgtctcagcctcttgagtagctgggactacaggcacatgccaccacacccggctaatttttgtatttttagtagagacaaggtttcaccatgttggctaggctggtcttgaactcctgacctcaagtgatcctcttgccttggcctcccaaagtgctggtattacaggtgtgaaccaccatgcccagccaccaaatgatacctttaaaactttcttttagagattttaaaaccaattgtatgctattctttaaacaagctatttcttacagtgtaaaaattaactttaatcctatcatctgggaaaatcagttacattgtacttgcttgaaactgtatttttgtgtatacacgttttgccatctatattttctcacttttttgagtttttgaaacatgctttgtaacccatgaatttaatggcttgcactagtattggatatgtaaaaatatattttcaggttttagttgttctttatgtgtgattataaataacatcatagtttacaccactggcacttaatattgaatttaaattggttttagtattttctatcataaaagcaaatgtgtccatgtagaaagctttaaaaataacaaattattatccagagaaccactgttgcagatatactaaatctttattcattcaagagccatgtttcagcacctgttaatagcagtcactgcttcagatatgaaacctgctcttcagaattaacatcctcatatacttagtcatatatcttgtcagtatcctatgatcagaaatgtgtatgttttaaaaaaggaaccatgctatttagaaattgtattgtaatctaatttttctccgataacctattaagaaattccttccatgccattgaaccatcctttacaatattatatttaatggccacaaaacaattatttgtatgaatgtaccactcttttccaattcccttttgcattttaaatccataacatgtgcactttacttctctttgatagcatgactaatatgttctgcacaagacatgaaggcacagacagcactgtctttcttcctcattctcataacatctctgagtggatctcaaggtaatttcgtttgtaatacaagtgttagttatttgcattatcagatagaaacatgagcacacaatgcaaggtggctatttcctccatagccacagcatcgtgaactttcctaaatcatcagttaatcagaagcaaggaacaggctggaagtctgcatgaagactaaaaattatatatattttttctgtccactctgattaagactctttctaatctgttgtctgctaccagaagtaagttcactggaaaggcaagtttgattgattgatttttttttttttaagtgtaagcttggtacttaccacttgacagaaggcattatcagctttgctaggtcctatgacaggcattcttaattatccagtgaaacattagaggggtttagcagagcaattagagagatcgacagtcactcttttcctttcccatctttctgtgtctttctttcagcatgatgccacatccctctagctctctgcagagagattaagtctctctgaggaagagaggcgggacatggtagggtagaaagagccccagaagggaaggtagaggataaagactgtgacagagccacttgggcacgcagttcttccatcttgggtggcctgggccatgagccaaaggagttactccattgtccaaaaaataaggtcctttccagtgctaatatcttagaatccatagacagggcacaagatctacttaaaatattttgtaaatcaaagcagttagattacctccttcaatgataggaagtgtctgggtatattttctttgcaaaaatctcttattctgttgatttcatttgctttttgaaattaacttg

SEQ ID NO: 197 - DNA, 2666 bp, Homo sapiens
  cDNA HHLA2-001
agttctcttcaagtcatgtaatcgacttttttgaattagttttcagtttcattttgttttccctaattcaagttgggaacacttcattttccccaattcaagttgggaacacttccttggtatttccttgctacatggactttagcaaatgctactttactctccttccagctactcaggaggctgaggcaggagaatcgcttgaacccgggaggcggaggttacagtgagccttttcctagttttactgttggaagcctaactcacaggagagattatgcaatacagtcctgaagtcaagggaggagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 198 - DNA, 2548 bp, Homo sapiens
  cDNA HHLA2-201
aaatcaaacgtaccttggactttactctctgagaaactcatagctgaattcaatgtttattcttatggactacttagcatttgactagacggtatgaatttctaagtaagcacatatagaactggatgcccttgtggtacatctcaaggctgatttgaaagcttgagagaccatcaagaattggatttggggaagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcac

SEQ ID NO: 199 - DNA, 2406 bp, Homo sapiens
  cDNA HHLA2-006
agtttactctacatcatagcagagaaaatggacaaaacacagctgttttgcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 200 - DNA, 2379 bp, Homo sapiens
  cDNA HHLA2-004
atttctcatctcagcacatatagaactggatgcccttgtggtacatctcaaggctgatttgaaagcttgagagaccatcaagaattggatttggggaagagcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 201 - DNA, 1457 bp, Homo sapiens
  cDNA HHLA2-003
tattcttatggactacttagcatttgactagacggtatgaatttctaagtaagcacatatagaactggatgcccttgtggtacatctcaaggctgatttgaaagcttgagagaccatcaagaattggatttggggaagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaa

SEQ ID NO: 202 - DNA, 1439 bp, Homo sapiens
  cDNA HHLA2-002
ttattcttatggactacttagcatttgactagacggtatgaatttctaagtaagcacatatagaactggatgcccttgtggtacatctcaaggctgatttgaaagcttgagagaccatcaagaattggatttggggaagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagaaagatgttgtgtccctcctggtgagcgctgtcccagtgcacccgataatggcgaagaaaatgtgcctctttcaggaaaagtatag

SEQ ID NO: 203 - DNA, 2659 bp, Homo sapiens
  cDNA HHLA2-005
gattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtggtaaggcattatttcctttatcaaaccatatacagtataaaaatgcttctttaaaagggtaattgaagttctgactgattcacatatcatcaagcaagacttttatacagaaaaaaacagcagcaggggttgcaggataatatagcacgaaaaatataattaggcttttcccaatgtctataattaaacaggctctacttgcttaaatacatggttgttcttcttgtctcctattgttatttgtagagaagatctccaatggcattgtgcatatgagggtgagccaatgtacttattcttatgatagaagcatgaaacatgggattgtatacaagtggaaagaaacacaactataattcacttgcaaattatagtttgattgtatacttcctttttactgcattccttttagtatttatgtgttccattaatcagagtataaataagggccaggagtgtggtaaacttgttttttccactgttaaaaaccatgaaacagctagtagggagattaaaattaactgataagactcagacttattttataatggtctcatggatctttaatttcagatgcaagcaatagactaaagctttttgccgcccaccccaaaacactactatcaataaatatttaagatataaatggttattctgacttgaacaacagacatttagagtctatttttcttgcttctagcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 204 - DNA, 594 bp, Homo sapiens
  cDNA HHLA2-008
gtttattcttatggactacttagcatttgactagacggtatgaatttctaagtaagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgt

SEQ ID NO: 205 - DNA, 585 bp, Homo sapiens
  cDNA HHLA2-007
ttcttatggactacttagcatttgactagacggtatgaatttctaagtaagctactcaggaggctgaggcaggagaatcgcttgaacccgggaggcggaggttacagtgagccttttcctagttttactgttggaagcctaactcacaggagagattatgcaatacagtcctgaagtcaagggaggagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataat

SEQ ID NO: 206 - DNA, 573 bp, Homo sapiens
  cDNA HHLA2-010
attcttatggactacttagcatttgactagacggtatgaatttctaagtaagcacatatagaactggatgcccttgtggtacatctcaaggctgatttgaaagcttgagagaccatcaagaattggatttggggaagagcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgcta

SEQ ID NO: 207 - DNA, 568 bp, Homo sapiens
  cDNA HHLA2-009
atagctgaattcaatgtttattcttatggactacttagcatttgactagacggtatgaatttctaagtaagcatgtaggagaatactaaccctgcacagattgtgatggtgatgtggaatatactaaagcctagaacgcacctcctctggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtg

SEQ ID NO: 208 - DNA, 25616 bp, Homo sapiens
  Coding Sequence of the NCR3LG1 Gene
aaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccggctgtgtctccgtcaactctttacgcaacagaggtctccccctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtagggggcggctggggtgggctggggcgggggctcctggcgccagagggtcctcgcgggtcggctccctagcatcccgccaggggacctcaacttcctgggggctgagagctctattttcttttctatttcttctcctttttttttttttttttttttgagacggagtctcgctctgtctcccaggctggagtgaagtggcgcgatctcggctcactgcaagctccgcctcccaggttcacgccattctcctgcctcagactcccgagtagctgggaccacaggcgcccgccaccatgcccggctaattttttgtacttttagtagagacggggtttcacagtgttagccaagatggtctccttgacctagtgatccagccgcctcggcctcccaaagtgcggggattacaggcgtgagcccccgcgcccggcctgggggctctattttcaagcgtccctcctttgtgagaagcggagtccccgatgcaacaggtttacattgaaggcctgccctgtgcagggtcgacacctgtgagagcggaaacggtgcttccttggatgtcgcgcgtttggtgcctcggtatttggcgcctctctcgcatcatccgaggggccggaggagagaagaaaatcagggaatcggtaaattggaaaaatcattcatccgcatatcagtgggtcctcctggctttgctaagttaggtctttactgagagagggaggggagtgttttgatcttgtggtgaccttcaaacgttctcttgcttttttgggaactcgtatgggcgtgttctgcgttaacttaaacaggagactaaaaggctgaaacgcgtatgtagagatatttaaactcatttctaactagaagaatggcaattaaacaacaagatgctgcttgacccttactaggctggccaaaatacgctcctgggtgccgggtggtggaggtggaatgtaggaatcccggaggcgcgctctgggcgccccgagtcactgcaggtggaggagagccgcgtgtggacctcaccgtggagaccttggcggcagcttcacaccacgcccttgctgcttgccgagcagcgtgaacggatgttgaaggcgtagagccaagtaaacagtggacatacaatgcaataccatttccacagtttgagaaacagaagatacagccttaaagagaacaaaaattacatgttaaacaccttagaatggctgcccgatgggagagggaagtggaaataaaaacgagtgaatagtatttctatacatttgcaataagcaatgtgaaaataagacagttccgagtgaagtgtgggcggtgaagtggaaagccaaaattgcgcttgtctccgcgctgcggacttgaaacgcctgtcactgcggtctggaaacgcctgtcgctgcggtctggaaacgcctccgcgctctatcagtctgggtctcctcgagctcgaagtggcgccagtgggctgccgccgcgcccacccggtcccatgcccgtcccgcgccccctcccgggcccggcgccccctcctcaggggccttgggtccccgccactttcgtccggtctcggtccccgcggatgctggtggtggtggagaagggccgcgagttctcagggaagcggagagggaggaacgccgtttggctgtgcggcggcgcccagtgacggcagcagcagcagcagctcctggaggaagctagttccggctcgtccagccacgaggagcgcggcggcggctgcatgagggtcggaccccagaaccaggcgttggtgctggactttggcaccggaagagactgtgaaatggaaaaccgtttcggaagctttcgcctaacaaatcatttccgcctacaagaaattcctacaccttaggatggagcatctgtttgcctggctgctattctgcgtggaagcaaatttaaagtggtacaagaaaaaaaaaatccagtcatacaaaggaattcgtcagattttaatgcaagagattctagcccgtctttgtatgagaatgtctttaaaggttgttgatatagaaaatgttttaaagaacgttaggttttatttcagaaatgaagttgaaaagagcaatttgtaaagctgtagttaacagtcctccctagttggagagctctagaactggaggttctctatgtaggttataccactagttgatttgaaaagataaatgcataaatgcttttccttggaaacaagactgcagaaaattccaaggatctagtccttgaaaaaggcgaatgctgttaagctgttaaggtactacactctgtacctttaaatgaaaatacatggaggtcctgggtgagcgcttgggcgctctgaaaatagacgaggtttcccaaatttgccttctaaattttgatttgttgatttaaatcttctaaatttatgtagtctggcactcaggtttgtattccttttaagcacatgttagtgtttttgatattttcccttctccctccgaccccccaattcttcttcttttttttttttttttttttttttttttggtagtcacttttcgtttttaagagtgacaatacaactaggtggcctggctgtttcatatccttggtttctccatttcttggttggccaccagggggaagcatactgtttttttggttacagttgaccctatcttcattttgtaggtcaagtctgtttttgctttgatacatagaacagaaagcttgtcaccgcgtttccctaatgtattattttaaaaaatagacttgcacaaatctttgagtaagttggcaggtttttggatacatttttgttaacattaattttgaaaactttatttagatatgttggatgtgactaatgaaaggacatgtttgatggcaacaaggggaattcggtttctgacatttatctaaatatagatgtctagctctgcattgttagtaatgagtctgacttctttggagttgtactcttctttgaaatagcaaatgtaatattttgaactgtccttgcactttttgttggaataggtataagcgtaaacttgctagcaacctactgttctaaaatggaaaacatctagccagtcgcagtggctcatacctgtaatcccaatacttgaggaggcaatgagaggattgcttgagcccaggagttagagaccagtctgggcaacttagtaagactccatctctacaaaaaatgaaaaaattagctgagcatggtggcatgtgcctgtagtcccaactacttgggaggctgagacaggaggatcacttgagcccaggaggtggaggctgcagtgagcagtgatagcaccactgcactccagcttgggtgacacagcgagaccctgtctctaaataaataaataggaaaacatcaaaaaaaaaagagaaaattctctttacaatagcatcaaaagataaaatacttatgagtaaatttaacgaaagaaacagaaaatatatactctggaaactgtaaaatattgctgaaagaaatttaaaatctaaataaatgaaatggaaaaatgtcctgtcttagtcttgccaggctaccataacagatatatactgtgtggcttaaacagaaatttatttctcatgattctggaggctgggaagtccaagaggaaagtgtggatgatctggtttctggtgagagcctcatttctagtttatagaaggataccttcttgctgtatctttacgtggtggagagagacatatctctctgtcatgtcttttcttatttatttatttatttgtttgtttttgagacagagtctcactctgtcactcgggctagagtgcaatggcattatcacggctgactgcagccttgaacttctgggcacaagggatcctctcacctcagcctcccaagtagctgggactacaagtgctaaccaccatgctgggctaatttatttttatttttttgtagagacaaggtcccattatattgcctagtctggtctggaacacctgggctcaaacgatcctctggcctcagactctgggagtgctgggattataggtgtgaaccaccaggcccagcttcatgtcttgtctttttcttttcttttctttctttctttttttttttttttttttgagacagagtgtcgctctgtcacccaggctggagtgcagtggcatgatctcagctcactgcaacccctgcctcctgggttcaagcaattctcctgccttagcctcccgagtagctgggattacaggtgtgcaccaccacgcctggctaattttttgtatttttagtagagatggggcttcaccatgttagccaggatggtctcaatctcctgacctcatgacctgcctgcctgggcctcccaaagtgctgggattacaggcatgagccaccgtgcctggcctcatgtcttttcttgtaagggcactaatcccattcgtgaggactttcctcttatgacctaatcgcttcccaaaggccctgcctccagataccatcacactgggggtcaggcctccatatgaattttggaggactcaagcattcagtccatagcacatctcaaaaagatgttcatacattggtaaactgaacattgtgtcctcttattgccacaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtgggtgagtgtctcggggcagtgccctacagttcccatggtgttggggttagcaacaacaaaacccacacacctctttgagctccactttcctgtattataaaatggtctgataatacatggatgagcttggtggctgtattagtttgctaaggctgccataacaaaataccattgactggatgcctttaaacaacagatgtttatttttcacacttttggaaggctagaagtctgagatgaagacatcagcaggattggtttcttctgaggcctctcttctctggccatcttctccctgtgtcttcacatggtctttcctttgtgcctatatctgtgtcctaatttcctcttcttataaggataccaatcatattggatcagagcccatcctaataaccccatttttaacttaattacctctttaaagaacctatctctaaatacagtcacattcagagatactgggaattctgggaggacataagaattttaggaggacataattcagcccagcatgggccctccataattgtacataagactttgaatgttttgtccgtagtaattttgggagtgagaggcatattaattaggattcacttcctctgcaactgacagaggaataacagtgacagtggctatatatacggccaactgacagtggccgtatatatatagccactgttcttctaggctttatatatctatataaagggtctacataggagacagggtctccctctgttgcccaggctggagagcatggcacaatcatagctcactgtaacctcaaactccagggctcaagtgatccccctgcctcagcctcctgagtagctaggacctcggttgcatgccaccatgcctggcgaatttttacatttttgtagagatggggccttgtgttgcccaggctcgtctccaacttctggcctcaagagatccttgtgcccgggcctctcaatgtgctggcattacagggatgaactaccatgcctggccaacagtggcttttaaagacattaatagactttttttaaggacagttttagatttacagaaacattgcaaaaatagtatgagagttctcatatcactcacgccctgcataccatttcccctgttattaacatcttgtattcgtatggtaccttgatataattaatgaacccatattgacattttactataatgaaagtgtgtaatttattcatatttccttagtttttacctaatgtccttttcctgctccaggatcccgtcagaataccacattgcatttaattgttatatgttcttaggctcctttttgctgtgacaatttcttagaccttatttttgatgtccttgacagtttggtgagggtattggtcaggtatattgcaggatgtcactaagttaggatttgtctgctgttttcctcataattggacttggggttatgggtttttggaggaacatcgcagaggtaaactgccattttcatcacatcaaatcacatgacttatgactgttgatgttgaccttgaccatctagttgaagtagtgtttgtctggtttctctactgaaaagttactcttcctcctattttcatactgtactctttgaaaggaagtcactctgtgcagcccacacttaaggttgggggttacttatgttcttcctccttggaggtggagtatctacataatttttttaagaattcttctgcatgggagatttatctcttttctcccatttatgactttattcaatcattgatatcaataaggactcaaggatatttattttatactttgtgttataatgcaatactactttattttttctcaaatttttccagctttggccacggggagctcattcacttggctcttgtgtcacattgacataccccaatcattgtaagattttgttttgttttattattttattttttgttttatttaatttttggcaaattcatatcaagaattttgtttgattttaagcactttttacattttggcactataagatgctccagactcatcttgtatatttcctctcttgtatatttcctggttctagtcctagaaccaaccaatactccaagaaaccttggttccttttattggaaagtgatcttagaaaccaagacctggacagtaagtgtactttttgctgctgaggtatcattgattctagaccctctcagccaacagagcaaagaaatacatgtatgcatactaacctctgcatatacacatatctacaaatatttctatgtgtaaccatctgtacctatattacattaaacatttgttcttactgatgtctccaactttagtccatcaccacatagatcattctagtttccttctcttgctcatctgtaaactcccactccaacagtgagaaacctgtacccaccatcctctgtttattgaattaattattaacctgtactccgataagaaacaactttatctactagagtacagtgctttttggcaattccttttttttttttttttgagattttttttttgagacagtcttgctctgttgcccaggccggagtgcagtggtgtgaccttggcttactgcaacctccacctcccaggtttaagcgattctcctgccttagcctcccaggtaactaggattacaggtgcccgccaccacgcctggctaatttttgtatttttagtagagatggggtctcaccatgttggccaggctggtcttgaactcctgacctcagatgatctgcccacctcagcttcccaaagtactgggattacaggcatgaaccaccatacccagcccagattttagccattttaataagtatatagtggtatctcatttgttgttttaattagcagttccctaatgatataatgttggacatcttttcatattcttacttgccattcgtatgtcttctttttttgtgtgttcattggttgtccaggctggagtgcagtggtgtgattacagctcacttcccaggctcaggtgattctcccaggcttcagcctcccaagtagctaggactacaggtgcacatcaccatgcctggctaatttttgtattttttgtagagatagggttttgctgtgttgcccaggctggtcttgaactcctgggctcaaatgatctgcgtgtctcggcctcccaaagtactgggaattgtatgtcttctttgatgagatgtttgttcagattgtttgcctattttttaactgggctcattttttaaattgttgtgttttaagagtcctttgtacattctggatacaagcctttatcagatagatgtctcacagatattttctcacagtctgtggcttgtcttttcattctcttaacaatgtcttttgtagagcagaagttcttaattttaaaaagtcgaacttactacatttttctttcatggatcatgctcttaacattgtgtcctaaagctcatcaccaaacccaaggctacctagattttctcctgtgttatcatctagaaggtttatagttttaccattgacatttaggtctatgatgcagtttactttaatttttgtgaaaagtgtaaggtttgtgtctatattctatatgtattttttttttttttgcatatgaacacctaattgttccagcatcatttgttgaaaagactgtcctttctccattgaattgcctttgcttctttgtcaaagatcagttgaatatatttgtgtgggtccatttctgggctttctattcagtttcttttctttttctttttttcttttaatacaggctggagtacagtgacacaatcttggctcactgcagcctctgcctcctgggccctggcaatcctaccatctcagctttccgagtagcttgtgctacaggctcgcgccaccgctcccagccaatttttgtatttttgtagagatagagtttcgccgtgtagcccaggctggtctggaacttctgagctcgagtgatctcccccgtctcagcctcccaaagtgttgggattataggtgtgagccaccacaccctgccctattcagtttcattgatctccctcttctttccccagtaccacactatcttgattattgtattttagtagtaagtctggaagtcaggtagtgttagtccctcatttttgttgcctttcttcagtatagtgttagctatctgggttttttctttccatacaaatttgagaatctgttgatatctgcaaaatggctttccgggattttgactgggattgcattgaatctagagatcaagttgggaaaaattgacattttttttttttttttgagacagagtctcgctgtgttgcccaggctggagtgcagtggtacaatctcagctcattgcaacctctgcctcctgggttcaagcaattctcctacctcagcctcccgagtagctgggattacgggcatgcgccaccacgcctggctaatttttgtatttttagtagagacgggtcaccaagttggccaggctggtctcaaacacctgacctcaaatgatccaccagcttcggcctcccaaagtgctgggattacagatgtgagccaccacacctggccaatggtattatatttttaatttcaaattccagttgctcaattgttcattcctgtcaaataattgatttttgcttattaactttgtatcctgcaacttgctttaatcacttattcattctagggatttttttgtttttgtttttgtttttgtttttggccaagtcttgagatttttctacataaatcaggctgtctgttaaaaatacagttttatttcttccattattttattttattttttacagaggtgaggtctcactatgttgcccaggctggttttgaactcctgagctcaagtgatccccctgccttggcctcccaaagtgctgggattacattgtgtgagccactgtaccaggcctcatatttcttccattctaactttataccttttatttccttttcttgtcctgttatgctagcttagacttccattacaatgttgcacaggagtggttagaagggacatcttgtccatttctgattttactttctaaccatgaaatatgatattagctattttttggtagatattctttagcaagttgaggaagtttcccttttattcctagtttgctaagagtttttcatatgaatcagtcttgggttttgtcaaatactttttctgcattattggtatgatcatataattttttctttagcctgttgatatgatgacttacattaaccaatttttgaatgataagccagccttgcatatgtgtaatatgcctctcttggttatggtatgtaattttttctgtattgttggattatatttgctaatattttcttgaggattttgtatctactttaatgagtgatattgatctgtagttatcttttctggtaatgtctttatgcggttttggcagtaggataatattgggcttgtagaataagttagaatgtgttccctctgtctacttctactttctggaagaaattgtaaaaaactggcattatttattccttaaatgtttagtaggattaaccagtgaaaccatccgaacctggtgctttcctttttggaaggtgatttttttcttcttctttttttttttttttactagttattgactcagtgtctccttccttccttccttcctttctttctttctttctttctttctttctttctttctttctttctttctttctttctttctttctttctttctttccttccttccttctttccttctttctctctctttctttctttctttctttcttcctttcttcctttcttcatttcttcatttccttcctttctttctcccctcccctcccctccgctcccctcccctcccctcccttcccttcccttcccttcccttctcttccctttcttcctgcaacgtcttgctttgctgtccaggctggagtgcagtggtgcgatcatggctccctgcagccttgacctcctgggcactagcgatactcccacctcggcctctggaatagctgggaccacaggcatgcaccaccatgccctgctaatttaattttttttttttttttaagagatggagtctatgttgcccagactcgtcttgaactccctcggctcaagtgatcctcccaccttggtctcccaaagtgctgggattacaggcatgagccaccatgcctggcccactaaagcacttctttttatgtttctcgcacagcaggtctattggtgaaaggtttgtctgagaaagtctttatttatacttcacctttgaaggaaaatttttctggatataagattccatgttggtgtttttctcttttttaagtttcaatgctttaaatatttcacttcactctctccttgcttgcattgtttctgacaagaagtccagtgttgttcttgttcttctatatgtaaggtgtgttttttttcctgtgacttttttctgtctttcttttccctccctccctccctccctccctccctccctccctccctcccttccttccttccttccttccttcctctttctctcttttcttttcttttctttctttcttcttttgagatggggtcccactctgtttcccaggttggagtgcagtggtatgatcacggctcattgcagcttcaccctagtgggctcaagcccaagtgatcctcccacctccgccttccaagtagctggggccacacgcgggtgccactaagcatggctaatttttgtattttttgtagagatggtgtttcattatgttgcccaggctggcctcgaactcctgagctcaagtgatccacctgccttggtctctgaaagtgctgggattataggagtgagctaccatgcttggccatctttgtctttctaaagttgaaatatgatatggctagacgtggataggcatatttggatatttatcatgcctggtattctctaagcttcctgggtctttagtttggtgtctatcattaattttggaaaattctcagccattatttattcaaattatttcttctgctcctttctcttttcttcttcttgtattcccattatatatctgttacaccttttgcagtatcccacagttcttggctattctggggttttttttaaattcttttttctccttgtatttcagtttgggaagtttcttttttaaaaattgtttgtgatagggtcttgctctgtatcccaggctggagtgcaatggcgggatcttggctcaatgcaacctctgcttcccaggttcaagcaattcttgtgcctcagtctcctgagtagctgggactacaggtgtgcacaaccatgctggctaatttttgttttttaagtagagacggggttttgccatgttggacagggtggtcgccaactcctgacctcaagcaatctgcccaccttggcctcccaaagtgcttggattataggtgtgagccaccacaccgtgcccagtttgggaagtttctattaacatcttcaagctcactgattctttccttgtcagtttctttttttttttgagacggagttttgctcttgttgcccagtctggagtgcagtggcgtgatctcaggtcactgcaacctccgcctcctgggttcaagtgattatcctgcctcagcctcccaagtagctgggattacaggcatgcgccaccacccctggctaattttgtatttttagtagaaatggggtttctccatattggtcaggctggtctcgaactcctgacctcaggtgatccacccacctcggcctcccaaagtgctgggattataggtatgagccattgcgttcagcctccttgtcagtttcaagtctactgttgaacccactgaaggcattcttcatttctttaatggtgttttgagctctagcattcacttttggttcgttcttagcatttccatcactctgcttatattatccatctgtttgtgcatgttatctgctctttctgttagtgctcttaacattttaattatagttttttaaaattccctatatgataattctaaaatctgtgtcatacctgagtctgggtctgatgtttgctttgtttttatgtattttttagccttgtaattttttagttgaaagagagatattatgtatcaggtaataggcttttattatgcggccttatgttaatttggctaggagctgggttgtgtttaatgcttattgtagctataggtgccagagacttcagtttctctagtgtttttttctctcctttcctattgtctttgggtttccttatgaactccttaaataggttctgtgccttgtagctctctcacttataatcttctgttattatactggagccctgttgatgtggtagtaaagtgttggaggagaatctgtttatacttttatgattaaatcttattcttttagtggcctgagcctctggactgtggccttcagaagtgtttcttagccttttctctttctctcttcttaagtaatacagaaaggctatagacagctggagttggctaattttcttctctcaggtcagataaggctctgacatcttcccttgagatggagggaataatctaggtatattttaaaatgattacttctttccatcccccagaaagaggaggagatttttcttggctctttactgtgagaatctggtggggttcctggaagtaaaactcatgacagtgtgatagcatccccaagactgggtcccgaggatgaaaacccatgaaagtgtggtaagcatccctaagaccaggacctgaggaggtttttattctcaagctagtccacactcatcctttagcagtttgtcggagttactgcttaagtacttctactggtttatgactccagcagcttctgcatgaggtgatttgatcttagctgtaattttcttaatctccttctttctccagttttctgagtggcagtttgccctgtcacttcaattctctgaggaatctaagaaaagctgttgattttcaatttgttcagcttttgttcttattatagggtgggagtgatgacctctcatgtgagagggaaacctggaagtcaatagtggctttggaaatggcagtttatttttctttcacactaatgtagccagcccagggcagatatggcagctagctctgtgatcatctgggacccatgatccttttatcttgtcactctgccatcttcagtatgtatcgtccaccttgtgtttggaaatggcttatccatctccagtcatcacatagtattccaaacattctgcaggaaataaggagagagagagaaagagacagtcttttaagacatccttttagtttaaggatacttcctagaagttgctcttgccacttttgcataaatccaggcctactagacccctgagtttgcatgaccaaacatacctgcagtggaggttgggtgatacaggtttaatctggatatgtcatggccagctaaaaatgcacagaatggaaattgaagagcaattagcagtctctaccacaacagtgttccaaggctttcctcagattatgaaaggtgtctgtttcacaacacagcttaagaaaactctgctttacaaaattgctgtgagagttgtggtcacagcatgtcagtacccggttggcactggcaccaacatacccagaatatttagcccaagctgacttgcattcagtcactcacatgtcctgaaggcttaccatggctcagatgtcaggctgataataagctaatccctccctacccttaaggagtgcccagtctggtattgtaaatctccagctcattgctggacatggttgcagcatttttaaagagtaggcatcctgtgttttttgtcttatctggctacaggagcagtgatgcatagctgtgagggtatggtagaagccagttagcataaggtgtggtggggataaaagggtgctgggcccaactctgtatgattttttttccctgacagcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctggtaagggtctttctggacatttcttctcttccttgccttgagggactataacataagacttattcccacacagcctgggtcttagctggggactgaaggggaaacagagaaagcttggactggaaggaccaagctggagtctggcctagctcagccccagagtcagcagtccagcctaggtccctacacctgggcagatgatggtcttagtaggtggagagtggtgactgtagtcatcaggtggagcagggctatttgtcagctcatggcagcttcagggttttggatggtccatatggcttgaaataggaaacctgccagttgctaggggaatggggacagtatcctacccgtgttccctgaggataaggggctatcaggggccagggaccagtcctgctagcagcccttctaataaggctctaggtccactgtaaactgttggctggtagaggctgactcagtagtcttgtcttttttttttttttgagatggagtttcgctcttgttgcccaggctggagtgtaatggcgtgatctcagctcaccacaacctctacctcccgtgttcaagcgattctcctgcctcagcctcctgagtagctgggactacaggcatgcaccaccacgcacggctgattttgtatttttagtaaagatggggtttctctatgttggtcagactggtctcgaactcctgacctcaggtgatccgcccgcctcagcctcccaaagtgctgggattacaggtatgagccacagcacccggccagtagtcttgtcttatgggctgtgtcccaagatggggagggctacagtagagtggttctgcaaatgctcaatgccttccccaggcacactggatccttaaaacacagttcacggcagacccactcctgctggtgggctggggctttttgagctcatatgccttggtcatagctctggtcttgggtgtgggtggctctgctggtaaaatgcatctccctggggctgagaagagtaaggaaggcagggagtgactggggcactgaggaatgtggtcaggcaatgccatatggggcccaggatgatcctggggagagaggaattattcttggaagttaggactaggtgtgtgtgtgggtggcatgtgcagggatgcagggagggtatgtgtgtccatggggagtatgaaatggaaatataccttgcatgtatggtacgaggggttgtctatgtggtatgcacatagggatagaagatggtgtcgtattacacaaggtttgaagatgagggtagcacaattatgtggtacgtggtgttcatcttccatatttttggcaagtgctacatacactgtttgatgtatggaggtgtatgtgataggaatggagatgctgagacatgtggcagagggctggtggttaaatctctgacaaggaggatgacacaaccacacagttcccagcagcagttgtgtggtttctctggcccttgccagtaggtttcctgctaatgttttccttctctctctgcagaaactgagaagacagataatttttccattcattggtggcctatttcattcattggtgttggactggttttattaattgttttgattccttggaaaaaggtaaggggctccaaagcaaagttcagccctgtgtcttgggctagtaaaaagcttttagagcagctgctgccaaccttacaagcctcaagggacaggcctgctggaaaggactttgtcagtccctcttcaccatcaggtgttgggaatgttggctgtgttccaatccagtttcctatcacagaggacctagctgtcacataccatctgacctctgtatggtggtttgtgactctggggtgatgtgttgtaaagcctccctctctttctccatactaaacaagtattatatctctgtgaatgaaccagactttagtgttcagaccaggccctgaactatgtgtggactgcttgtttttctcacacatttagaaactatggcttagagaggggaattcctcatattttatctgatcaataactgaccaccagatctcactagtttgactaagaatttctaaccctcactaggtatttctaaactaaaacatgtttctaaacatttttatccctgactatggcccaaatagtaaataaaacagctcaagctttagaggcccaagagacctatgtaaatgtgttggttaaaatagttttagataataaaagggccctcaattatttatgggcctgtcaaggcaaaatctgcacaacagccagtacatctcattataaataatttaggagaagtggaataatcagtcaattaagaaaaatggccctttatctaaagttggccatttagattcacgggacttattcctgttggatctaggccatgagaaaactggataaaaagtggttttcaaatgtttcttgtggtatttgtgactgttgtcatatttcttgcctttctctggttctgatattcaggtgctattgagagaggaggaaggaagaaactagtcaggcaggcagttagggtgggccctcagtcaaattccttcaaacaaaagaacagcctgaaaaatcaaactgcagataagggaacttgtacaggggggcttgcctaaaacatgcccacagccacatacattaaaacaaggctacacaggagacttgcctagacatgctcacaatagaaaattccatcccctgacacatgcacagtaaggggaacaaagccacatggagtaactcaagctaagggcttgcatgcacactacgaggatggggtggagctaccagaaatgtgtgccttatgcctttgtattcagctgtgaaatggcaaccctcttttgggccccctctctgcagtggagtgctttcttcttttgcttattaaactttcacttcaacttcatctttggggtccgcgctccttaattttcttggtcatgagacaaagaacttcaggtgataccttgggcaatgagagactgctacattgtggtgcattgacgagactaacattttggtgcattggccaggaaacattggaagggtgagtaggagcggacctccaaactctttactttcatttcagaggcttcttgtcctcagattttttcctgaagactgaacaaaacactgggccagttaaaagcttttagagcggctgccaaccttatgagacttaagatacaggcttgctggagaggactttgtcagtcccccttcaccctcaggtgttgggaatgttggctctgttctaatccagtttcctttcacagaggacttagctgtcacatgggctagaaggaggtcctggggcaactgaaggtttctgtttgaggctactcctcagtgttacctgaaggtccctggactaactccagcccccgacagcccgtcagaatgttggcaccaggacttccagacttttctattgcattttcttccttgcttttcgcagctactatgtctcctattccttctttgtatgcaatgttgtgggtgtctttatagcctggggagataatcctgttaagcaaagtcagcaagtgccttagtaacgaggaatgtaactcaaataattgttgtttttgtgatttccttgagacagggggacttcaagatttcagcctaaattttcacttagggcctttttgtcccccagtgatagacattcatggcactctatagggggatgtttcaccccaagtgaatacccttttctccatcaggttgtttttccttcatgtaagagctcagcattgcccaatgaatttaagcattccctctatgagacaaactagttttttttctactggacagcatattatggggacagcctattaagccccaaacctccctttctgacctctgcttggaaagaatttgtagtcagagttttttcctaacatttcaaaccctatagtgctacctagtgggatgggatttttctctgtgagaagccttgtcagccctttgcccaaaacctctagttccctgattcctttctctcttatgtccctctttcagtgatcaggccccatgccctatttgtaagcataaaaactcctctttcaacagccaggaagaagctaccctgggaagacatattttagcctcagtgttatccccattggagggagaacagccattcaatttttacattcttttgaggcatctgttctgtacacagctacactggcatctaagtgagaaagggatcttgtgtttagaaatcaatcagtctcattctctaggaattcataactttgccagggtggtagtaagaggatgtaaggatagagttaagatgttcccttccttaaagggtcttgccccaatccaactactgcacaatctctcccatggttctagggaatctcaggagccttatgggccaagtaggtctaggaaaccagcagggcagagagctaggaccttgtgcaggtgagcacaagctagctcctccggattcatgggtgaaggtcatgctttgatccatgggcagcacctataatggtcaccaggaacctgaggaaatgggagggaagaggagaagggggacgccccttccatttttctctctgctgtcgatcactccagaaggacaaaggagactaagggatgccttttctctcctctttttctagatatgtaacaaatcatcttcagcctatactcctctcaagtgcattctgaaacactggaactcctttgacactcagactctgaagaaagagcacctcatattcttttgcactcgggcatggccgtcttaccagctgcaggatggggaggcttggcctcctgagggaagtgttaatattaatactattcaacaactagatgttttctgcagacaggagggcaaatggtccgaggttccttatgtgcaagccttctttgccttgcgagacaacccagatctttgtcagtgttgtagaattgaccctgctctcctaacagttacatcaggcaagtccatagatgataattccacaaagtctgagaaacaaacccctagggaacactcggatgcagttccggatgccccaatccttcctgtctcccctatctgggaacctcctccagccacaacatcaacaactccagttctatcctcccaacccccaactttactgttacccctacagtaaatgcctgatggacctggtgccactagggtccaagttcccttttcattacaggaccttgggcaaataagaggggacctgggcaagttctctgatgacctgatagatatatagaggctttccaaaacctaactcaggtgtttgaccttacttggggtgatgttatgttgctcttaaactcttaactactacagagaaacaggtagccctgcaggcagcagaaaaattcagagatgaacaacatgtcttctatagccactcaataaggaaagaaggtgagaaacaaccagcattcacatacccaataggaagcgaggcagtgccccttgaacaacataattcggaccccagtggtaccttagatgagtggcaaagaaaacattttcaaatgtgcttattagagggcctacagaggaccagagccaagcctcttaattaccccaaactctccatgatagatcaaaaactagatgaaaatccctcagcctttttggaaaggctgagagaggctgtagtgaaacacacttccttgtctcctgttaggtatgtttatacctcacataaataattcaattgagggacagctaattttgaaagacaagtttattactcagacagcccctgatatcagaaggaagctagagaaacaggccatgggattagatagcaccttacaaaacctcctgaaggtagccacctcggtcttttataatagggaccaggaggaggcccaggggaaggagaggaaacacaagaaaaaggcagagactctggtggccactttgtataaaacccagtatccccaaggtacacctgctagttgctaccaatgtggcaaactagggcacttcaaaagggactgcccaggcagcaagaagaagccacctcaaccctgtccagtatacaatggggaccactggaaggcagactgtcctgggaagcataggtcactgagtccagagccagtctcacaaatggtccagcaggactgatgggtcctggggctcaactccctggctccagtggctcagactgctgttactacccgggagcaccaggtgattctggagttcgaagggaggaaggtagacttctttctggacactggagccaggcttctgttttcctctccaattcaggccttcgttcctcccatagcacaaccatgatgggcatctcaggaaagactttaacttgatatttttctcaacctattagttgcagtcagagggacctactgtttacacaggcctttttagtcatgcctgaaagtcccactcctttattagatagagatattccagcacgtatgggggccaccatccttatggctccaggacaaactccgcctccccttagtggaaaccagtattaacccagaggtttgggcaactcagggaagaagtggccggactataaccactataccagtctggatccacctcaaggatcccactttttttcctaaccagagacaataccctctgaagccagaaagtagaaaagggctagacgccagcattgataacctaaaggcacaaggcctccttaggccttgcagtagcccttgaaacaccccaatattaggggtgcaaaaatccaatggggaagggagactagttcaggacctctgccttattcatgaggctgtgattacgattcatccagtagatcccagtccctatactttgctaactcaaatatccaagggaactaaatggttcacagttctgggcctaaaggatgcctttttctgtatacctttataccctgactcccaatacttgtttacctttgaagacccctccaatcaaaccacccagttaacctggactgtactgcctcagggatttagagatagcccccacctatttgggcaagtattgtcaagagatctcttcgaattcttccattctcaggttaaagttttacaatatgtagatgacattctcctctgtgccccaactgaggaagtttcttgagacggcactgaggctctccttaatttcctagctggaaagggatataaggcttcaaaatctaaggctcagctctatcagactttggtaaagtacctaggtctggtcttgtcagaagggaacaagagcactaggcgaggagaggattaatcccatttcctcccttcctctccccagaaccctcaagcagctgagggatgcttgggcattacaggtttttgtaggttatagatacccaggtatgataaaataggttgccctttatatcaccttataaaagaaattcaagtggctaaaactcacttcctgacctgggaacctgaaggtcaaaaggccattaatcagttaaaacaagccttgcttaaagcaccagcccccagtctttctgtagggaagtcctttaatctttatgtatcataaaggaaaggaatgaccctgggagttttaattcaagttcaaggcccagctcaacagccagtaggttacttaagtagagagcttgacttggaggctaaaggatggccagcttgcctctgagcagttacagtagtggccctgctagtcccagaggccaccaagttaaccctggggaataacctgtttatgcctcacataaataatgtggcaggcttgctgtcctctaaagcgagtctctggctaacagacagctgcctcctcaagtatcagactttgctgctagaggaatctgcagtccagttaaaaacctgaccttgcctgatcccagacactttcctcccagaggaaactggagaaactgaacataattgtgaacagactgtagtacaacctatgccgctagggaggatctcaaagaaattcccctagaaaatccagactggacccactttatggatgggagctcttttgtaggacagggagtctgaaaagtgggatatgcagtagtcaccctaaataacattgaaaatgtgcctctctcaccaggcacacacactcaatcagttgagctgatccctctcacaagagcacttgaactaagcaaaggaaagacagctaacatttatactgactccaagtgtacctttctagttctccttgcccatgctgccatctgaaaggaaaggcacttcctcaccgctaatgggtcttgcattaaataccatcaagacatcaacaggctattatcctcagtgttcctcccatgagaattagtggtcagacattgcagagggcatcagaagcgggtagatgaaatagcgaaaggaaacaggctagcagaccaaagagctaagtcagcagtaagaaggccccaaggtcccaaaacacttgaggcccctctgatttgggagggctacataagggaaataaagcctcagtattcccctacagagatagaatgggccacctctcgaggtatacttttcaaccctcaggatggttacaatcagaagattgcaaagtacgcttgccagcctccagccaatggaagattcttaaaatcctccactgagcctttcacttaggaaagcataagacatcagtgcatccaaagattgttctcaggagaaaatctactaaaaatggtcaaataggttgttaatactcgtgaaaccctcttaaaaataatccctttaacagatgacttcttccccaccacaatcaaaggatgggaagttactcaggggaggactggcagatagacttcacccatatgcccaaaataaatggcattcaatgtcttttggtgtgggtgcataccttcattaactgggtagaggcattcccatgcccaacagaaaaggcctctgaggtggtgagaatactaattagttaaataattcctcactttgggctccctaagtacttccaaaacaacaatggtccctcatttaaagaagcctctacccagtagggccgagtctgctaggactttttattgggtttggtaatacgtcacaccctttagcctctactgtgtcagccatgtcccatttatacaagacaaattgctgggtctgtcctgagcggtttgctcagttcagtaacactaaggaacctcttgatgacttggtatttactgtcttagcattccctttgttagctttacctttagccattaaagacttgtcaggcataaatggaacatggtatgggaacactttcaactgagtaactaactcctcccaggaaagcatttcctccctggtgccagaaaacactttccccaaagataagcctcacaccctcaggctaggaaaagttggccgggtaatagcaaatgcctcctcctgttttaaaagcagaggaaaaggaccatacctgggagatctcaaatattataacaccatacttgtaattgctgaaagctcggaagtttggagaaaaagacataagaaggatgatctaagaaaattggaagccatatggaggggaggctttcagaattcagcgtctcctcctggttgaaagtcctgctgggaatggcaggctctgggtaaccaccctgacacatggcactataatgtaaaaaacaacacataggccttcccagacatgcaccctcatgggattccagaccccctgtatgatgcttagtagtagtggcctacaaatctgtgggtgaacagaacaggagacttctggactgacagcccctgtcacaagggggcattatctgagatattggccagggcatatcgtgtccctggtcttttgaaactccatttgtcggccaggtgtggtggcttacgactgtaatcccagcactttgggaggctgaggcaggtagatgatgaggtcaggagttcaagactagcctggacaatatggtgaaaccccgtctgtactaataatacaaaaaaaaaaaaaaaaaaa

SEQ ID NO: 209 - DNA, 11550 bp, Homo sapiens
  1st Promoter of NCR3LG1
catctcttatgaacaaatatttttttaatcataaccatcatataattatcaaatttgggaaatttaacattgttacaatactattaatctaacacatagtccgtattcaaatttcaccaactgtctcaatactgtcctttataataattttttcatgatccaggatttgtgtgttggattttgttgtaaggtctctttaatttcctttgatctggaatagctcctcagttgtattttgtctttcatgacatttacattttttgagagtacaggtcatttgttttatagaatggctctcaatctgcatttgtctagactggtctttctcacagtgtggtctgtgactggtgctggtctatgcctggctgttacctaatggtgagaaggccaaccaacattactcatgctgttggaaacttttatagcaattcaaaaataattttatgtcttttgaatctaagaataaaaattgagggcttggatttttatgtctttttatttcatttctctagtaattcatttttatttcacaaaatgacagttcttcgtgggttggacacttattttttatttttacttttattttttagaattaagaaaaaataatagagacaggatcttgctatgttggccagttggtcttgaactgttgccctcaagcagtcctcctgcctctgcctcccaaagtgggtgagccaccatgcctggccaggttggacacttttaaagagtccttcagcacagctacttggaacaacaatggtctagaatgaggtgttttttgtttgtttttgtgttttttttttttttttttttttttttttttttggagacagagtctcactctgtcacccaggctggagtgcagtggtgcaatcatggctcactgcagccatgacctcctggccttgagccatcctccctcccacctcagcctctcaaatagctgggaatataggtgacaccaccacacccagctaatatcttgattttttttgtggagatggggcctcactatgttgcctaagctgattccaaactcctgagctcaagtgatcctcctgtcttggcttcccaaagtgctgggattacaggcataagccactacacctggcctagacagattttttgaagctaaggactgtgctttagccatcgctgaattcgtcactcctagattgtgcctggcagagttcaataaattgttgctgaggggcaacttgaaatgtcccattcctttaatagaaaagctttcctttcctttttttttttgagacagagtcttacacttgtcactcaggctggagtgcaacggcattgatctcggctcactgcaacctccgcttcccgggttcaagtgattctcctgcttcagcctcccgagtagctgggattacaggcgtctgccaccacacctggctaagttttgtatttttagtagagacagggtttcaccatgttggccaggctggtctcgaactcctgacctcaggtgatccacccgcctcggcctcccaaagtgctgggattacaggtgtgagccaccgcgcccagcagaaagcttttcttatactgagccaaaatctctctccaacttgcttttgccttcaagaacatcacctaacatgtgtactcacatacacaggtgttagcttttcagagacttacaagactggtaccatttcttaaacccccaggctactccaaacaaaatgggctcagctcctttactcatttgtagtgattaggattaggttctgctgaaaatgagaacattttaaataagagtagcttactgactttatttcttatgttccacaggtccagaggtgtccttctaaagctggtagaggtttcacgagtcatcagggacccagaacccttctcttttgctgtccctttgtcctagtgcatggtttccacactgtggtgcaagatgtctcctcaagctctaggcattacatctgctatcctgctgtcagaaagaaggaaggggaaaagaagatcatttccttctctttaaggacatttcccagaagtcacacagaacatttccatttatattactttggccagaacttggtcatatggccacatttagttccagaatgattaggaaatgcagtcttttattgatccctgtgcccaggaaaatattggaggcctttttcaaggaaaaaggggaaaacagatattggttgacaaatagcagtctctgccatactgtccctggatacatgtctttgagtgaatgtcccttatttaccattctgattacttgttggatattttcaatatgtgttacaatatggttccaaaattgtatgtgatattccaacagcaagttggatgcaatgtgtcataaaaatgacctcagtgtcaaccagcatttgaataccgtgtctcaatgctgtgcaccaataaagaacacagaaagtcagagttttccataaataattcctgagaatatatgcttattttgtttgagaagcatcgtgaggtatctgctgtgtgctttagggttgaatggaaagttggcaaaagtattaaaagacatgttcaggccgggtgtggtggctcacgcctgtgatcccagcactttgggaggccgaggtgggcggatcacttgaggtcaggagttcaagaccagcctggccaacatggtgaaactctgtctctactaaaaatacaaaaattagctgggtgtggtggcaggcacctgcaatcccagctacttgggaggatgaagctgaggcacaataatctcttgaacctgggaggcagaggttgcagtgagctgagatcacgccactgcactccagcctgggcaacagaacgagactctgtctcaccaaaaaaaaaaaaaaaaaaaaaaaaaaaaaaaagatgttcaaatagacatgatattggtaaaaacgaaaacacaggtaatgacttttcattctaatgaaatataaatagagaaacctgccggttttaccctttagagtaaaaagggtacaaaaaaattaccaaaacagtaaaaattaccaaaagagtaatttgataatttctacagggtgatgtgtatgtgtcacaactttgtgaatcactattctgggcatgtataagaagtcgtcatatacctccattgggaatgttatttaatgatgtcactaataccagacaaggatgtctcctcaggtaaggctccttggaggaggcagaggttgagaagaggtgtaatttaggttttaaaaattcaatagctggacttaaccttgcatatctctacctgttataacggtggtccggaaggctgcgatctgaaggcccctcagctagttgctgccactgtgggcactctgcgcatctttcacttctgagctctttctgtatgcactctgttctgcagataagtgagaatgtgactatttgcttagtcagtgacagtgtctctaaccctggaaaggaagcttttactctctcagttttagagacatgtgaacaggctggggatatgaggtcacttacccactgtcttataatcagcagatggcatggttggcattggagtttaggtctgtctgtgcttttctgtacattacatcctttttaatgatgcgaaggaaaaatgcagtagggtcaatgagacaaatggaatgcaggttgctggggaaagaatgcaggttctgcgttataaatgcacacacatttactgtgccacttgggttctgaactttgcggttaaattgatttaaaaactggtgtagaggtggtaaaacttaatcaccgaatgagaatatttgggtttgcttcaggaggtcgcaagccacttcttgattagtagaaatgggaaattaagggccaccttcaggcgtttaactgaattgtcctggggatttaatttgcctttcgacttaatgctaaatttttgttgtttttggtttttaaagtaatgtaagtttatcgcgccaacggtaagatgtcgctctggacgcgtgcacctgctctcgcaatcaccgactgcggtcagcatcttccttagagcagcgccccgggccacttggatcccggtctcaatttactaagcgaacccagaggatgccccgagtcctggaccgcagagccgctcgcgagaggcaccggggctgtaaccgcgcaacctcgtgccgcgggcggaggcgagggaggattccccggccggtgcccgcccccgggctaaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccggctgtgtctccgtcaactctttacgcaacagaggtctccccctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtagggggcggctggggtgggctggggcgggggctcctggcgccagagggtcctcgcgggtcggctccctagcatcccgccaggggacctcaacttcctgggggctgagagctctattttcttttctatttcttctcctttttttttttttttttttttgagacggagtctcgctctgtctcccaggctggagtgaagtggcgcgatctcggctcactgcaagctccgcctcccaggttcacgccattctcctgcctcagactcccgagtagctgggaccacaggcgcccgccaccatgcccggctaattttttgtacttttagtagagacggggtttcacagtgttagccaagatggtctccttgacctagtgatccagccgcctcggcctcccaaagtgcggggattacaggcgtgagcccccgcgcccggcctgggggctctattttcaagcgtccctcctttgtgagaagcggagtccccgatgcaacaggtttacattgaaggcctgccctgtgcagggtcgacacctgtgagagcggaaacggtgcttccttggatgtcgcgcgtttggtgcctcggtatttggcgcctctctcgcatcatccgaggggccggaggagagaagaaaatcagggaatcggtaaattggaaaaatcattcatccgcatatcagtgggtcctcctggctttgctaagttaggtctttactgagagagggaggggagtgttttgatcttgtggtgaccttcaaacgttctcttgcttttttgggaactcgtatgggcgtgttctgcgttaacttaaacaggagactaaaaggctgaaacgcgtatgtagagatatttaaactcatttctaactagaagaatggcaattaaacaacaagatgctgcttgacccttactaggctggccaaaatacgctcctgggtgccgggtggtggaggtggaatgtaggaatcccggaggcgcgctctgggcgccccgagtcactgcaggtggaggagagccgcgtgtggacctcaccgtggagaccttggcggcagcttcacaccacgcccttgctgcttgccgagcagcgtgaacggatgttgaaggcgtagagccaagtaaacagtggacatacaatgcaataccatttccacagtttgagaaacagaagatacagccttaaagagaacaaaaattacatgttaaacaccttagaatggctgcccgatgggagagggaagtggaaataaaaacgagtgaatagtatttctatacatttgcaataagcaatgtgaaaataagacagttccgagtgaagtgtgggcggtgaagtggaaagccaaaattgcgcttgtctccgcgctgcggacttgaaacgcctgtcactgcggtctggaaacgcctgtcgctgcggtctggaaacgcctccgcgctctatcagtctgggtctcctcgagctcgaagtggcgccagtgggctgccgccgcgcccacccggtcccatgcccgtcccgcgccccctcccgggcccggcgccccctcctcaggggccttgggtccccgccactttcgtccggtctcggtccccgcggatgctggtggtggtggagaagggccgcgagttctcagggaagcggagagggaggaacgccgtttggctgtgcggcggcgcccagtgacggcagcagcagcagcagctcctggaggaagctagttccggctcgtccagccacgaggagcgcggcggcggctgcatgagggtcggaccccagaaccaggcgttggtgctggactttggcaccggaagagactgtgaaatggaaaaccgtttcggaagctttcgcctaacaaatcatttccgcctacaagaaattcctacaccttaggatggagcatctgtttgcctggctgctattctgcgtggaagcaaatttaaagtggtacaagaaaaaaaaaatccagtcatacaaaggaattcgtcagattttaatgcaagagattctagcccgtctttgtatgagaatgtctttaaaggttgttgatatagaaaatgttttaaagaacgttaggttttatttcagaaatgaagttgaaaagagcaatttgtaaagctgtagttaacagtcctccctagttggagagctctagaactggaggttctctatgtaggttataccactagttgatttgaaaagataaatgcataaatgcttttccttggaaacaagactgcagaaaattccaaggatctagtccttgaaaaaggcgaatgctgttaagctgttaaggtactacactctgtacctttaaatgaaaatacatggaggtcctgggtgagcgcttgggcgctctgaaaatagacgaggtttcccaaatttgccttctaaattttgatttgttgatttaaatcttctaaatttatgtagtctggcactcaggtttgtattccttttaagcacatgttagtgtttttgatattttcccttctccctccgaccccccaattcttcttcttttttttttttttttttttttttttttggtagtcacttttcgtttttaagagtgacaatacaactaggtggcctggctgtttcatatccttggtttctccatttcttggttggccaccagggggaagcatactgtttttttggttacagttgaccctatcttcattttgtaggtcaagtctgtttttgctttgatacatagaacagaaagcttgtcaccgcgtttccctaatgtattattttaaaaaatagacttgcacaaatctttgagtaagttggcaggtttttggatacatttttgttaacattaattttgaaaactttatttagatatgttggatgtgactaatgaaaggacatgtttgatggcaacaaggggaattcggtttctgacatttatctaaatatagatgtctagctctgcattgttagtaatgagtctgacttctttggagttgtactcttctttgaaatagcaaatgtaatattttgaactgtccttgcactttttgttggaataggtataagcgtaaacttgctagcaacctactgttctaaaatggaaaacatctagccagtcgcagtggctcatacctgtaatcccaatacttgaggaggcaatgagaggattgcttgagcccaggagttagagaccagtctgggcaacttagtaagactccatctctacaaaaaatgaaaaaattagctgagcatggtggcatgtgcctgtagtcccaactacttgggaggctgagacaggaggatcacttgagcccaggaggtggaggctgcagtgagcagtgatagcaccactgcactccagcttgggtgacacagcgagaccctgtctctaaataaataaataggaaaacatcaaaaaaaaaagagaaaattctctttacaatagcatcaaaagataaaatacttatgagtaaatttaacgaaagaaacagaaaatatatactctggaaactgtaaaatattgctgaaagaaatttaaaatctaaataaatgaaatggaaaaatgtcctgtcttagtcttgccaggctaccataacagatatatactgtgtggcttaaacagaaatttatttctcatgattctggaggctgggaagtccaagaggaaagtgtggatgatctggtttctggtgagagcctcatttctagtttatagaaggataccttcttgctgtatctttacgtggtggagagagacatatctctctgtcatgtcttttcttatttatttatttatttgtttgtttttgagacagagtctcactctgtcactcgggctagagtgcaatggcattatcacggctgactgcagccttgaacttctgggcacaagggatcctctcacctcagcctcccaagtagctgggactacaagtgctaaccaccatgctgggctaatttatttttatttttttgtagagacaaggtcccattatattgcctagtctggtctggaacacctgggctcaaacgatcctctggcctcagactctgggagtgctgggattataggtgtgaaccaccaggcccagcttcatgtcttgtctttttcttttcttttctttctttctttttttttttttttttttgagacagagtgtcgctctgtcacccaggctggagtgcagtggcatgatctcagctcactgcaacccctgcctcctgggttcaagcaattctcctgccttagcctcccgagtagctgggattacaggtgtgcaccaccacgcctggctaattttttgtatttttagtagagatggggcttcaccatgttagccaggatggtctcaatctcctgacctcatgacctgcctgcctgggcctcccaaagtgctgggattacaggcatgagccaccgtgcctggcctcatgtcttttcttgtaagggcactaatcccattcgtgaggactttcctcttatgacctaatcgcttcccaaaggccctgcctccagataccatcacactgggggtcaggcctccatatgaattttggaggactcaagcattcagtccatagcacatctcaaaaagatgttcatacattggtaaactgaacattgtgtcctcttattgccacaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtgggtgagtgtctcggggcagtgccctacagttcccatggtgttggggttagcaacaacaaaacccacacacctctttgagctccactttcctgtattataaaatggtctgataatacatggatgagcttggtggctgtattagtttgctaaggctgccataacaaaataccattgactggatgcctttaaacaacagatgtttatttttcacacttttggaaggctagaagtctgagatgaagacatcagcaggattggtttcttctgaggcctctcttctctggccatcttctccctgtgtcttcacatggtctttcctttgtgcctatatctgtgtcctaatttcctcttcttataaggataccaatcatattggatcagagcccatcctaataaccccatttttaacttaattacctctttaaagaacctatctctaaatacagtcacattcagagatactgggaattctgggaggacataagaattttaggaggacataattcagcccagcatgggccctccataattgtacataagactttgaatgttttgtccgtagtaattttgggagtgagaggcatattaattaggattcacttcctctgcaactgacagaggaataacagtgacagtggctatatatacggccaactgacagtggccgtatatatatagccactgttcttctaggctttatatatctatataaagggtctacataggagacagggtctccctctgttgcccaggctggagagcatggcacaatcatagctcactgtaacctcaaactccagggctcaagtgatccccctgcctcagcctcctgagtagctaggacctcggttgcatgccaccatgcctggcgaatttttacatttttgtagagatggggccttgtgttgcccaggctcgtctccaacttctggcctcaagagatccttgtgcccgggcctctcaatgtgctggcattacagggatgaactaccatgcctggccaacagtggcttttaaagacattaatagactttttttaaggacagttttagatttacagaaacattgcaaaaatagtatgagagttctcatatcactcacgccctgcataccatttcccctgttattaacatcttgtattcgtatggtaccttgatataattaatgaacccatattgacattttactataatgaaagtgtgtaatttattcatatttccttagtttttacctaatgtccttttcctgctccaggatcccgtcagaataccacattgcatttaattgttatatgttcttaggctcctttttgctgtgacaatttcttagaccttatttttgatgtccttgacagtttggtgagggtattggtcaggtatattgcaggatgtcactaagttaggatttgtctgctgttttcctcataattggacttggggttatgggtttttggaggaacatcgcagaggtaaactgccattttcatcacatcaaatcacatgacttatgactgttgatgttgaccttgaccatctagttgaagtagtgtttgtctggtttctctactgaaaagttactcttcctcctattttcatactgtactctttgaaaggaagtcactctgtgcagcccacacttaaggttgggggttacttatgttcttcctccttggaggtggagtatctacataatttttttaagaattcttctgcatgggagatttatctcttttctcccatttatgactttattcaatcattgatatcaataaggactcaaggatatttattttatactttgtgttataatgcaatactactttattttttctcaaatttttccagctttggccacggggagctcattcacttggctcttgtgtcacattgacataccccaatcattgtaagattttgttttgttttattattttattttttgttttatttaatttttggcaaattcatatcaagaattttgtttgattttaagcactttttacattttggcactataagatgctccagactcatcttgtatatttcctctcttgtatatttcctggttctagtc

SEQ ID NO: 210 - DNA, 3392 bp, Homo sapiens
  CpG Insel of NCR3LG1
tggcattggagtttaggtctgtctgtgcttttctgtacattacatcctttttaatgatgcgaaggaaaaatgcagtagggtcaatgagacaaatggaatgcaggttgctggggaaagaatgcaggttctgcgttataaatgcacacacatttactgtgccacttgggttctgaactttgcggttaaattgatttaaaaactggtgtagaggtggtaaaacttaatcaccgaatgagaatatttgggtttgcttcaggaggtcgcaagccacttcttgattagtagaaatgggaaattaagggccaccttcaggcgtttaactgaattgtcctggggatttaatttgcctttcgacttaatgctaaatttttgttgtttttggtttttaaagtaatgtaagtttatcgcgccaacggtaagatgtcgctctggacgcgtgcacctgctctcgcaatcaccgactgcggtcagcatcttccttagagcagcgccccgggccacttggatcccggtctcaatttactaagcgaacccagaggatgccccgagtcctggaccgcagagccgctcgcgagaggcaccggggctgtaaccgcgcaacctcgtgccgcgggcggaggcgagggaggattccccggccggtgcccgcccccgggctaaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccggctgtgtctccgtcaactctttacgcaacagaggtctccccctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtagggggcggctggggtgggctggggcgggggctcctggcgccagagggtcctcgcgggtcggctccctagcatcccgccaggggacctcaacttcctgggggctgagagctctattttcttttctatttcttctcctttttttttttttttttttttgagacggagtctcgctctgtctcccaggctggagtgaagtggcgcgatctcggctcactgcaagctccgcctcccaggttcacgccattctcctgcctcagactcccgagtagctgggaccacaggcgcccgccaccatgcccggctaattttttgtacttttagtagagacggggtttcacagtgttagccaagatggtctccttgacctagtgatccagccgcctcggcctcccaaagtgcggggattacaggcgtgagcccccgcgcccggcctgggggctctattttcaagcgtccctcctttgtgagaagcggagtccccgatgcaacaggtttacattgaaggcctgccctgtgcagggtcgacacctgtgagagcggaaacggtgcttccttggatgtcgcgcgtttggtgcctcggtatttggcgcctctctcgcatcatccgaggggccggaggagagaagaaaatcagggaatcggtaaattggaaaaatcattcatccgcatatcagtgggtcctcctggctttgctaagttaggtctttactgagagagggaggggagtgttttgatcttgtggtgaccttcaaacgttctcttgcttttttgggaactcgtatgggcgtgttctgcgttaacttaaacaggagactaaaaggctgaaacgcgtatgtagagatatttaaactcatttctaactagaagaatggcaattaaacaacaagatgctgcttgacccttactaggctggccaaaatacgctcctgggtgccgggtggtggaggtggaatgtaggaatcccggaggcgcgctctgggcgccccgagtcactgcaggtggaggagagccgcgtgtggacctcaccgtggagaccttggcggcagcttcacaccacgcccttgctgcttgccgagcagcgtgaacggatgttgaaggcgtagagccaagtaaacagtggacatacaatgcaataccatttccacagtttgagaaacagaagatacagccttaaagagaacaaaaattacatgttaaacaccttagaatggctgcccgatgggagagggaagtggaaataaaaacgagtgaatagtatttctatacatttgcaataagcaatgtgaaaataagacagttccgagtgaagtgtgggcggtgaagtggaaagccaaaattgcgcttgtctccgcgctgcggacttgaaacgcctgtcactgcggtctggaaacgcctgtcgctgcggtctggaaacgcctccgcgctctatcagtctgggtctcctcgagctcgaagtggcgccagtgggctgccgccgcgcccacccggtcccatgcccgtcccgcgccccctcccgggcccggcgccccctcctcaggggccttgggtccccgccactttcgtccggtctcggtccccgcggatgctggtggtggtggagaagggccgcgagttctcagggaagcggagagggaggaacgccgtttggctgtgcggcggcgcccagtgacggcagcagcagcagcagctcctggaggaagctagttccggctcgtccagccacgaggagcgcggcggcggctgcatgagggtcggaccccagaaccaggcgttggtgctggactttggcaccggaagagactgtgaaatggaaaaccgtttcggaagctttcgcctaacaaatcatttccgcctacaagaaattcctacaccttaggatggagcatctgtttgcctggctgctattctgcgtggaagcaaatttaaagtggtacaagaaaaaaaaaatccagtcatacaaaggaattcgtcagattttaatgcaagagattctagcccgtctttgtatgagaatgtctttaaaggttgttgatatagaaaatgttttaaagaacgttaggttttatttcagaaatgaagttgaaaagagcaatttgtaaagctgtagttaacagtcctccctagttggagagctctagaactggaggttctctatgtaggttataccactagttgatttgaaaagataaatgcataaatgcttttccttggaaacaagactgcagaaaattccaaggatctagtccttgaaaaaggcgaatgctgttaagctgttaaggtactacactctgtacctttaaatgaaaatacatggaggtcctgggtgagcgcttgggcgctctgaaaatagacgaggtttcccaaatttgccttctaaattttgatttgttgatttaaatcttctaaatttatgtagt

SEQ ID NO: 211 - DNA, 12415 bp, Homo sapiens
  1st Promoter of CD86
ctgcacccattaactcatcatttagcattaggaggtaaatctcctaatgctatccctcccccctccccccaccccacaacagtccccagagtgtgatgttccccttcctgtgtccatgtgttctcattgttcaactcctatctatgagtgagaacatgcggtgtttggttttttgtccttgcggtagtttactgagaatgatgatttccaatttcatccatgtccctacaaaggacatgaactcatcattttttatggctgcatagtattccatggtgtatatgtgccatattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcattgtggttttgatttgcatttgtctgatggccagtgatggtgagcattttttcatgtgtcttttggctgcataaatgtcttcttttgagaagtgtctgttcatatcccttgcccactttttgatggggttgtttgtttttttcttgtaaatttgtttgagttcattgtagattctggatattagccctttgtcagatgagtaggttgcaaaaattttttcccattttgtaggttgcctgttcactctgatggtattttcttttgctgtgcagaagctctttagtttaattagatcccatttgtcaattttggctttggttgccattgcttttggtgttttagacatgaagtccttgcccatgcctatgtcctgaatggtaatgtctaggttttcttctagggtttttatggttttaggtctaatgtttaagtctttaatccatcttgaattgatttttgtataaggtgtaaggaagggatccagtttcagctttctgcatatggctagccagttttcccagcaccatttattaaacagggaatcctttccccattgcttgtttttctcaggtttgtcaaagatcagatagttgtagatatgcggccttatttctgagggctctgtcactatacatctactagaatgggtaaaatccaaaaatctgacaataccaaatgctgctgaggatgtggagcaacaggaagcctcattgctccacatcctcagcagcatttggtattgtcagatttttggattttagccattctactagatgtgtagtggtatcttactgttttaatttgcaattctctaatgaggtatgatgctgaccaccttttcatatgcttatttgctgtccgtgtaccttctttggtgaggtatatgttcagatcttttgctccttattaaattgggctgtttgttcttttatctttgagttataagagttcattgtgtattttggataccagccctttatcagatatatcttttgcaaatattttttccccaatctttggcgtgtctttttattcatataatggttgatacatgtttctgctttaaggaggaagggttttaaaaatacaatttacagtagcagtaaaaataaaaatttattgcaaatgtcttatgttcactctcaggtgatgtcagggaactatggacccagcagggtttaattaaaggggagtgtcaagtcctgggggctgtggttgacaatcctcctttattggcaattgtgcagcagggctgggagtaagaagacaacccagtcctgagctgcatcacttctaaattaagaataattcaggaactgtgtttacggtgaaatcctggcccttctcacatagattatattatgcataggatatgaatttctgtccatgaatccaagtatatatgaaatcatcactttgaaaatttcctttaactcaacttaatcccactggtgagcctcaatcctgccagttgaaaaagagactgtaactgggtcatgcaggagtctccttcctttcctgcagcccagtcagaattcaagaagttcacctggtaactggaaaatgatggaagggcctcaagtccctagtctgtcctggttgccattggcacccttactatctgagcccatagtggtctgtgaagtccggcagctccctgcccccatgccacagtggggaatgagaatatctactgatgctgggccccatgagcaaagcatgctgcctttctaggcatgagccatcacacctgaggttgctaccccctcgggagcactgatggaggggcagttgggtttctactgctcacaggacccagacaaccatcccctgccctcccttcttcttgcacttcaaaagcactctcttcctctcttttcacctctaagccaccggtatcatctcttccatgggctttcacaaaagtctggatgaacctttgaacttgtatctcttctgctttcccccttgcatcaagaaagcttagaaaacaaacactaattaacgtttcaataaataatgctgctctaattatttgtggaaactattctgtattagaactaccatcagcaccgcctcctagagtgcttttagacttgaccactggccgcaggaggccacttccatataacaacaaacagatggctgaaattggaaaactcagctaaatgttcagatgtttctagactcccacgggtttctggctctggcacatggagtagatcctgactgtgtggtcctcaggggactctctctggtgaagtttggtgaggtcaacttccacacccacacacaccagctactgtgtgtagcctgtcctcctctggttgcttctacttgcagccttggcctcttcagtcctgagagcgttggagaatgaggcagtggaggaagcagccccacacagaaagcagtttctgaagtaacctcagcaacttcctcctcaccaaacacaaggaactgatcttctccactgggctcggcctctggtcagccaaggacaacactgttgaccaccatcacggttggccccactccacccttggctctgatgacatatgtgggagtcagaggaattttgattggctgactgctggcctgtcacacaaacaagatggggcaagggggttgcgatatgacttgacatgtgaaaaaaaaaaaagccgtggtcagcaaccccctgcaactgttgaaaggctaattcaatctctgactctttaacaaaagtgatcttgttcactgcctgttctgccctgagagccttctctgctaggaggtaggttgactgactcagggagaagggtgctggtggcagagctgccaatgggtgagggtcctagagactatcgacatgaggggcagttgagaacactgtagtatttagctgagaggagagactattaataaaatttacaaaatcagctttcagctatttggaagggtttatataaaaggataaaataatatgttctggtagttctagaaaacaggacagagacaagtagctggtacttatggattggaggagtgagtggcagtagtttggggattatttataaaaaagacatttttctgttaactctcttttctaatagtgaatttcccaacctgacaagtaagaaagcacaggctagacacgcatctgtcatgacactgaaggggtccttgcttgagtgagagactggaatgatgagttttgaggtcccttacagtccagcaactctagctaagttggagaataagagaattccatgacaccatatcaccccctcatttctgctgcctgcctcaccattcatctctctttactccttttaatatcattctacgttacagcattggaggaggctgctctaaataggaactgaaataagtagattaaagaagtgctatggaagggaaaacaataaaacaacttgttttttaagagcctactattgccaggatctgtgctaagcaccatatatatgccatgttatttaaccgtcatgacatgcctatgagatatttagtattacttctgtgaggaagccaaagctcagagaggttaaataactgccccaagaacacacaggcattaagtagtggagcagggtttgaacacaggtctctatgactccaaagtgcagtgtgatatgttatttttactgatctgtttatggaaaatgatactgctttctaatttagtattaacacaaagatttttttctaaatagatttacttaaagtatgttataaaaatactatataaataatgaaacagattttacatgagtatgaagtggtactagtagctagaatgatgaaagtttggggaatactactccaaatattttgatagctagcctttcaatttagcctgtcttatatttggactgctgagtacaaggaaaagaaggaaacatgaaaattaagtgaaatatgagttacttcccctgtgctctgataggtgggtaattgatcatatgtcacaataagaaaatcaaatgaaccctttcaaacaacagcaaaatctgtgattgtaaaatccagaggaaaaccccaggtgggatctatctgtatgaaggatgaaatttccaaggtctgaacatagaatggctgagaggaagtgatgaccctgtgagtcaagaccctggaccctgggggagccctgtgggtttgagaagccctgggtgaaaggtgaagggttttacaggcctgtttacagacctctgtagtgacagaagggagatctttgtgcaaaggtcaaagtaagaattgggaaagtctgaaaagaaaacaggaaagtaataatgaagatgaaataactacttggcatactctgccacatgatttacaggcaaggtttcctttgtttttcacaacaatgcagcaaagaagtgattatgagtcacatttcataagtgagaagactgacattcaaacatgttcaataactggcccagggtccagtggtcaagccaggactggacttcggaccaccagttccaaacccacaccccttcccttgcaccacacgcttttgtgtggatgagcctccccaaccctgtcaacaacaaactgtcactttgtcacttttaatgtctcctgcttcacaggacacagctagcctccaagagatcagggaggcatgcccagagggtgctgcttctctcttttgaagctcaagtgccacagacctcagaggcacataaatgtcccccacactgagcagaggactttgcagtgcctgatcagggcagaaaaaggaggcatgcacctgggggaggatcacatacgagtgaaacctgtccccgctgaagcactaggtttggagaaatctactgggcatttacacacctttcccacttctgcttatgacttgtagccaaactcaagagtaccacccacttccaggaatagtgtaccaaggtaacagaaacattctagattcatacaattggggttagattaggatcatctgaaaatgaaggttgtgtatgtcaattgccttctaacaggatgggtggagagatgtacttaatgaatgattttggggaagggctagaagtgaagcacatggcctctctgccctcactcattgaaggctgtcttctgaagccccgtggagctcagtgcctgtcacatggttgcccacatttgttgaactgaactgcattttcatctatgggcttcaaaggctgtgtgtactctgggatctctgggaatctgtcagggaaggtgtctttgtcatgtttgtggatggggctccctttgggggtttcccagggctttacactcatgctccgagggtacgtttgtagtcattctcatcagtggaaatgcccacctgccggcagaagttatttggaaccaagcaagagcactgtccctggctgtggtgttgtttctctagtcagttcccctttctgtatttgagttctaccgtcagtcctggcattatttctctctctacaaggagccttaggaggtacggggagctcgcaaatactccttttggtttattcttaccaccttgcttctgtgttccttgggaatgctgctgtgcttatgcatctggtctctttttggagctacagtggacaggcatttgtgacaggtatgtttgtggaggctcagacgcctagggagtggcatgagataaagctgcaagctgcatctggggcagaaatgctgatgtgctaatggccggccagagaatgagtaaaagggattgcagagagcatgcttaaaacctctgaccatcaggtttgcttctcagattgactacattggaggtgggatattacaaaaatctgtctcttcctgccagatcccttcatctgtttttcgtgagctaagagacaaaataggcaggaaatagaaggtgccacttaccaaataattggcagctgttcttggctttggggtgctggggtctccgagcagcctctgctctagaagaagcagtccaaagatgtcagctcgcctcgcctgagtcccctgtgccagtgggaaatccagagaagggggatttcctcctcttgcagcctctctgcaatggacttacttggctttcctgtttgacctttcccttctctggtccagagacccttccccaatatttcttcccatccaagtgccccatcccaatattagccccacttggcaccagagaccaagatctaatttaaaaagaaatattcttgggtcaaaaaagagcccaagcaagtgattgaacataatgtgtttcacatacggtgaacctatttgcatttgcatttgcaaacgggcttaaaatatcatctctattaatagcaatttaaggttctggagagccaggtgaaaatagtttttgacaaagggaacttcctactccccttaaactgtaataatgaaggaaatgaactgtttatcttacatgtaacctcaatcttgggactaaggccctgtactaaaatgcgtctatttatgtgctcagacttgcagttcgtgttatgtctgctgctgcagataccgttaatattatttatgtgagctatcctgtgtataatggaagcttttataaatctctatttatttattcctaatatagttattaagtgcttgctatgttccaggtactagggacttaacaggtagcataaaagacataaggaaaagctgcactcttgttttctagcctagtggggaaatcacattaatttaatcacactaaacatgactacatagcaatagtgctttaaagggaaggaaattgttctatgtgactatatcagctgattaattaccaagcctttgcatttgatattttggttagtctattcttcttgaatttcatatgcctcttcctgggtgggggtgaggatgggattttatggagttgaggctagggcaggtagggagaaaacatgagaaagatgaagagataagccaagccagattcttcagcagaaaaatcaaggttgaaataccatgtttcaaaaatcagactgaggtgggagttgaggttaggggtccctaggccaggggattgaagcttcaaagagataaaactagagcaaaagcaagcacagagagtggcagagaggtccctgggcatttttccacagtccattctagtgctggcaatccacctttcatggccaggcaggtaagagtatttgtggggtgggagaaaggacagggccataggctgggcacacagccctttactggcccttatctctcctctcttctcctatacagtgctgtttccgaactgtacattggcttacactcgggctgaggtttgggaaataggcgccattttgaatatgtgtggaggaagaaaagtgtgtcttcagcactttccacctccccatcacggccctgagacctcaacaccgggaagcatctcgttccctatcggtcctcctttattcatggacggatatgattcctttctaagttccatgtcctttttagataaattaacttgaacctaatgcctaatggcttaaaaacaaacaaaaaaaaccctcttccttccagctagcatttgcattttaacaggggctttcaaaaaatgccttagcccaaggaatgagtaatgtgggaattccaagcagcagggtaggactggtgcacagtatggggagagaaggcccctcaagttgtggccctgaaatgttggcttcctctctttgaccatgatgctgtttctgagaaaacaagaatcaggctaccttaggggaccaggatgggcatggctcccttttagtgagttctatgagcctcatacctgacagtcagagccctcgagtggatgagcacagactagaagaagcactgtgaaactttgcatgatccttacctttttggcaaaaaggaaaaaaaatcgttctcaaattcatcaatagtttgaaatagggtgtgccttgattcagaaagtttcgattctagatacaactcggagaactaggcgtgtcttgtacacagatttgctcttgggggaccggaaaagctaaatgctatcgccatgctatgctccttcttctaggccagtgaggggaacgcattcttcattttaatatttcagttgcctacaatattggaaggtggataaaagcaccctctgctccttctaaatctgcgaagacatttcttctctgcacctactcatccttgatgcagctctcctcatgtctgtatggaaacactgtgctctcaaatgagtttcagaaagaacaactcacgaaagaaaacaagcattcggtcagaaaaatctccacaaatggggaataagggggatttgctccaaggagagactggaaaccaagtcagacataaaatccagcctaagctagaaggagacatggctggtgggagcttgaggaaaacagagctcaggatggaggacgtctccacctccagtcatgtcctctgtccaccagacaccaagaagtgttcatgttccatcgaggcagccctcacacccatcccttcctcatcatgccgactgcctctttactgcttcaggctcaccatctcaagtcgacgagcctgtaatactggctttcttgatcaccctgataccagccgtcacctcttgacaggcttattttctttaagctgtcattacaccatttttctgctcccaaactattaattccaaacttccaattttctgttaaattaaatatgaattccttatttgactttccatgccctattaggctatcttgctccttgctttacttatagaaactaatctcccattatttatccaaagacaacctctgctgcaggccagtcagcttttcttactgtcctgtaaaaattccatggtcactcctccatttccatgtgtccttaaaaactgttatttgattgtgtctcagaaagtcgtcaaagaatatataccaatgaaaagcatcaaaaaggttatacttgatgttatgtgtgtatcaaaaatatggctgaaatatttatccagtgaaactcaatcaacactaaaaagtggttctttcggaagcatcagttctttgagacccattaaacagatgcctcggatgcagggttatatattatcaggaatctgtctagggaagaattattggaagcttgcaaagcctttcaaggacagaggacgatagctaccacgttgagttctaggaaattaaccattgttattgttaaaggaagacagcgtttctcagaggaagactgttaaacagtgcagtggcccaggctaacagccctcataagtgggagtatcagaatgagtggacttaattacttaaaaccaatacagggtggaacttcatctgctataacagaaatcaactcgtgcaagttctaacatgcagggtacagttctgagaccaagtctgactcacctgtcaaagctcagctcaactattaccacctttacaccacccttccaagctgtaggagtgcttgctgttctccatgtcttctgaagccctggatcacttgtagccagctcagcagactctacccagacagggatcctttaaatgtaccatattgtctactgtgttaaaaatgagaggaactgactcagggtgagagcgatggagtgtccagatgttctcctttatttctccttattcctggaaatgtaatgagaatcttagaggtgaactgaaaagttatgagttcaaccacttactcaattcgagattcgctcctaaaatgtctcttctgtgttatcacccccactttggtttgaatagtacttgtgacagggagcttatcacctcacaagaaaatccagtcattgcttgtagctctctattaaaagttttccatcatctggaactgaaatctggctccctgtaacttttagttattggaactacttgcccttcagcaacagtgtatgtatcctcccatggaagggcccttacatatttgcagacacccagcatatacttgcaatcttttcttcttcaggttcattaccctagtccttttagttgttcttcatttgacataatttcattattcactagtgaaccttgctgcccttccccttgataaaccgaatttgtcagtgtcattcaagtataactgacctcacagaacgtgataccacaagcgatgtggtctgattagcacagagttcagtgaatgaatcctacactaggattggatgaaatttacttagccataccacactaacacttatgtgatttttatgtttactatggatagactatttctcctgtgtccacttcttcctcttacacagttgttatttcaaaactgaagtacagattcttacacttaccctcaggagattcatcatgttagtattagtctctcttttcaggctttatgaatgttaattcagctaactcatttttgagctatctgtctcattttgtgccatctgcacagcataagtttgatttctgttgcttttattagtagttttactaaatacataaaagtgaaatagtgaaacacagagtcttgtagcatccactgtgggatcagtcttttagacaagaatgatgcagttgctgagtcaaatgaataaatgaataaatcaaacaatactttgtcctcatttcccatattgatctatcaccatatcctgttaattataattctaaatatttcttgatctatccacttttcccttacttcacctgctactatcccagaccaaacagccatcttctttcactcaaacaattgcagtagccaactgattggtcttcctgcatctgtcctggcttccctatcatccatttgctacacagaaaccatggtcatcttttcaaaatgcaaatctgatgatatcagtctcagctctaatttctttggtggttcacatataaagactgaaatctttaactgaccaataacacacgtgtgatctggcccctgctcacctcttcagccttgtctttcacctgtctcttcattttggccacagggacctcctcgtaccttctctcacgtgccctcctgcctcagcgcctttgcatatgctgttccctttgccgagaactcttcctgtcaactcccaagcccttcacctacttagcacctacctattcaatctgttctgtttgcctcttggtatgttacaaactgtctccaaacttagcagcttagaacaatgaatcctttaccctctctcacaatgtttggggtcaggaatttgagcgggccttggctgatttttctgttcctcatgccatcaattgatatcacctgatgttattaagctgatggatgggctgatctggagatgcactgtccagtttggtagccactggttacctgaaatgcagccagtcctaattgagatgtgctataactataaaacacccacatgattattgaagatttggtgccaccaaaaaatttaaaatattcgttaataatttgtattctgattacatgttgagattataatatttcacatacatcagataacataaaatgtcattaaaattaatgtcacctatttctttttaatttctttaatgtgactactacaagttttcaaattatatctgtggcttgtaattgtggcttgtattgtattctttttttctgagatggagtcttactctgttgcccaggctggagtgcagtggcgagatctctgctcatcgcaagctctgcctcccaggttcaagtgattctcctgcctcagcctcctgagtagctgaaattacaggtgcccgccactatgcccagctaatttttgtatttttagtagagacggggtttccccataatggccaggctggtctcaaactcctgacctcaggtaatctgc

SEQ ID NO: 212 - DNA, 7551 bp, Homo sapiens
  2nd Promoter of CD86
gatagataacttatattattgctgtcttcattttttaaaattctcaaatccagatgaaattatcaaagttgataaaataatcattgttctatcttcttatttgaagattaataattgtgttgattttgcttccttgctctagttagcagtgatgtcatctgctatttttaaacttccttgaaataatatatgtaatctacttctaataagtttttcttatttagcattttggtctaaactaatttataattatttagccttatttctccatgtttaacttgctttaaagctcagcactggtgttttcagccatggcttctccattttaaggctattttaattcatttattattctggaatatatccttaaataatttatttaggaaggctgtcttggtggtggtatttctgttgcagttgttgttttcttgcctgcttggtgacatatttctattgacttgacacttaactggcatcttatctaggtagataatgctaattcaaaattctgcagatattgttctgttgttttttgccatttagggttgagtaagatgccaagttgttttttgtttctctgtagtcattctgttttcattttgtttttagctttgcctttggaatttaaaatgttcaaaatgatttgtctggatgagaatcgattttcataacttttgctttgatacactaaacagtttgagtttctagatgatgcccattttaattcatacgaggaaatatcttctagtatagtttctgcttgattaattctatgtttgtctcttagggacatctattaattttataatgctgcctttttttcagacttctgtttcagaatattcgctttcatcaatgtaatccttggctatagtaggaatgaaataataaaagcagtagcttctgtctgccctccttggttatgcagtccttacagaacatctccccatctcccatccccccaccccagctcagtgaaactctccacactttggttgtggaaattggcagggttaggtggctactcactcccaatccacatccacaataaatcactttttattatcttatcaaaatctgtagaatgcctctttattctattttgttgctgcggaggtttgttttctctttctaattattttattttctaggttttttgagggaatttcaagaggggagattttttattcaggctcatcttaacgtcatgtctggaactcaagctactgaattatatattctttaatacatatagacctacgtcaatgagtttaaactgcaaggaaagggttaaatttcttcctcaagtgtggtcaaaatctgtagagaaaagaggaacagcttctcttaaagaaagttagctgggtaggtatacagtcattgccgaggaaggcttgcacagggtgaaagctttgcttctctgctgctgtaacagggactagcacagacacacggatgagtggggtcatttccagatattaggtcacagcagaagcagccaaaatggatccccagtggtgagtaataattcttattctttgcagagaagttatgagttgtgactgcagtgaaaggctgaggttgaagatggtgctttgatgtgtgtccttcacttagttcctaagtggagaagctttctttttctacaaaagatctttggcacataaaggcaagaattatttgcaatgcccaaagcagttcattggtggtagttatatatatttttaggtgcctaattttggttttgtaaatctgttattcaaatactgaatgttacagtcattgattttagtgaagaatcaggaatttttaaaatatctgcataagaatgacaaataacagggaatatgttttttgtctaccagggtcagtttggtctgagggtggaggaatgagatagagaaggtagagggagagagatcaagaaaaagaaagagaaaaaagaggtataaggagaaaatgcaaaactcagttaatatgtcataatcaggccatgggagattctgggcagggttgggtagtggaaggaggtagagtgattaaattagttaccatgtattgaacatgcatgatgtgctgggtactttactagtgctatttcattgaattttattcttcacaatgacttttggaaagacatcatcattctttttgacagatggggtaactgtggcttaaaaaacttgcccaagttcacactattcataaggggtagagctaaaatctttcctgcccgcttcgtggtgcgccagaaggtttctccatgctgtggagacttcctggaaggagtcacacccgcccttctcttgggtggtggcagctggcgccagtcactatgtatttatttatttttaattatttatttttgaaacagagtctcgctctgtcgccaagctggagtgcagtggcgcaatctcagctcactgcaacctccgcctctcggattcaaacgattctccttcctcagtctcctgagtagctgggactacaggcgcccaccaccacgcccggctaatttttgtatttttggtagagacggggtccaccatgttggccaggatggtctcgatctcttgaccttgtgatctggccacctcggcctcccaaagtgctgggattacaggcgtgagccaccgcgcacccggccgtcactatgtatttataattactgttctttgaaaatcgaagtaactttcatctacccagtgcttactggtttgagaaaaagctttgttgcttttatttcagaagattaaaatttaattttccagtaaagattccttttgctccagtggaattttgaagcgttatacttgtatgaagaaaaaaagaatttcaaaatttataatttttgtggtaccatagaggggatactacttaattatgctagcactgtctgcagaggtctaaaaaaccataggctgctgtctatattgaacttgttaagattccttttgtttcacagtgcctgaagattggtcatgaaccagtaatagccattaaacaatgtctgttctcataagagatgaaataaatacaaattaaaacaacagtgaagtatcattttttctctatcaaagagataaatattaagttttaaaaagcaagcaatcaagaaccctctatcttgctaagaagggaggattatttgtaccctagttgcgcactagtggtgatatcatctttctggacaataatctagtgatacatatcaaaagcctttaaaatgtatatgccctttaaccaagcaattcaccttttaggaatttattctaagatataataatacatgtttgtaaagttttagtgatggatatttttcttgctattgtttctaataaggaaaatcttagaaacaatttacgtgtttaaaaacaagtgattggatgattatggaacatccataatggaataccatgtaattatttaaaattccactgtagaacaattcataatgtgtttagttaaaggggaaaaatgcagaacgaacagtgctatcacttttatacatgatacatgtatacaaacaatattaatcagaaatataggtagtttgtattttctactgtgtgcttttcaatttgaatcccatctgtaggcagaaaaataaagttaaatatttaagatttaaaaaaaacaatagctggtttttttcagagaagtaaccatctagtgatgtgtgataatttataagttgtgagattccatagttagggctttagccctttgcatttatctttcttcatctcttgaatcctcttcaaaatacacccactctacccataactcattagatcttgaaaggcatgttctgatagaattttatatttagaacaggctgcagcactcttcccttattttacagaagtgattgcatggctctctagggtgagttgcatattgagagggaggacagtgcagtggctaagtggccgcacattgaagccaggctgctggggtttgaataccagttccccaacttcctagctatgtgattttggacaagttgcttaaccattgtaattcccagtttcttgtctgtaaaatgggagtatggtaatatgtcgtaaagtagttgtgagattttaatgagataatccatatcctgctaagtactcaggaattgttagtagtttttattactattactgtttggattaagaaacagaggaaaagtgatttgtccaagattatacaaccacttaatggcattactaagaacagaatggaggaaggttttttccagcagaaatgttcagtatcctctgtgcctggcaggacaaccccaagttgtgcttttgggatggaggagctgatctaaaacaagcagtacccaggacaaggccagcctccagggagtgactgatgacagtgggaagccaaatggtagaaaggcaggtgaagttaaggaaactgagagtcaacttaggagcaggaatgaagcctggagcaaagagctagtgcaagagagagcagatgactcagagctactggggcttttgtaggccaccagctatgggcttcacgggaggttaatgtggtttaaagtctcaagacctgggtaattaaatagacaaatggggtctaggtgcatgggggaattttaagtatagctttgagaagatgcctaatggggagtaataatagagaaagaagctgggtggggccagaacaaggagcccacagtccaggcatccagctatgatcatcctaaaggaacagcctaagtttgaagaatcataaacaaatagagacatgataaaatttactttaaaaaaaatcccttggcagaagaatgaaaactgatttggagtgacaaggagatcatttaggagactattggagtaagccaaggagaaatggcgagggcatgaaaccagggcagttatggtgggatcagactggagaggatgcatttaagagatattttagcaccagaattgacagaatttggtttttgacagatgtagacactgggagaggaggagagatctaagtgcatagtggcatccttcacaaaatggaaggtataggaagcagagtgggtttgcgccaggcagagagaaaagacagatggtgaattccttctctaacatgttgagtttgaggtgcctgtggagcagctggatagagatgtccaagcagacaagtagatatttaggtgcaagttcaaaaaagagggatggcctggaatgcacatgaagagtcttctgcataagtatggttgacagttgaaattctcattgtgggtcaattcagtagcagagaggttggaggattgagaggaagccaaggacagaacctggaaaaccttgacatctaaggagggagatgaggaagaagaatctacaatagatactaaggaggggctagagagactggagcagcccaggagaaaagtggtgtcatagaaatcaagtgggcctgtagtcccagctacttgggagactgaggcacgagaatagcttgaacccaggaggcagaggttgcagtgagctgagatagcaccacggcactccagcctgggtgacagagtgagactccgtctcaaaaaaaaaaaaaaaagaaagaaatcaagtggggagatggatgcaagaaagaggagaatgcattcatggaaagagcatatttaccaagctttccatgttgaacacatgagatgtgacatgaaaggtaactgtagtgactacatgttaagcgttgaattgtggctcccttaaaattcatatgttgaaatcctaactcccagggcttcaggatttgatcatatttggagatagggtctttacagagataataaaatttaaatgaggtcattagggtgggtcctaatccaagacaattgttgtgcttattgtaaggaagggaaacacacagcggaaaagcggtgtgaagacacagggcgaagacggccatccacatacaagccagagagaaaggctcgcaacagattctttcctcacaaccttcagaaagaaccaaccctgtggaaaccctaagtttggactcctggcttccagaaaaaaaataaattttttttgtttaagccaccccagtttgtggtactttgttaccacagccccagcaaactaatacacttggtgagagtgcatacagccagagaaagaagctgtgaataagtgcatcagggaggagggaaagaaaccaaaacaggattacatcacttaaattaagagtagaaacatttcacaaagcagagtgtagtcacaggtcaaattctgcagaaaggcgaagtaggagaatgactgaaaatgtcagtccagaggccctcagtgaccttgacctttgcagaacactcccagttgagtggaggcagtagactttggagagcttggaaaatggaggcagcacagatggtctcctgcagaaagtctggtgataaaatgagacctcctcactggagtaaactcacctctgctgtcggtggaaataatctggagtcaggccagccagacccagagttcttccttcctccattttaaaggttaaacagagctgaggtcaatggctcatgcctgtaatcccagtgactcaggaggcggaggtgggaggatggcttgaggcgaggagttccgttcaagaccagtctgagcaacatagcgagactcccattcctaaaaaaattttaatttaaattaaaaaaaaaggctaaccaaaaataaaatccaatactttatttttcccacccaaaactagtttgggaaggatttctggaagaaaataatttttgcagtcattttacatgttggattttgagtgcacataacatacagattctattctgtattatcagttcagaggcaagttgagatttgaggcttcgcagaggtaaagcctctggtgaatctggtgagataaagaagaaaacaagcccaagaggaatttcagggatcatttataatttacatcaataaacagaatgggaaaaaaaacccattagagtttggaatagagaagtattaaaacactttcttagaaagctttgagtcaaaattaatctttctgtagtggcaggaatatgataagccaaacaaccctaatgtcacagctctatattattaggtgtcgaatcagatttgcactaaaacatcaagtaaaaataaaaggaatgaacatttggttaagtgaaccaattagtcaatacacgccagaaaatggtaaaactggataaacctaaaatactcaactacctagattaatcaaggccaacctagattatcaccccaatattacaactattttcaaccaactaaacaataaatctttatcaagagcctgatagtttaaggtactgtgatgaatacaaatgaaattgctgatactttttttcaagtctatttagaaatagaaacccacaattatgaaatgacaaaaacaattaatgcagttaataattcagtaacttttaaaaagaaataaacatgacaaaaagttcattctcaccaaatactaaagaaatgccaattcaaacaccaatgagatattttcctgtatcagattagacagtaaaacaaacaatccaatcagaaa

SEQ ID NO: 213 - DNA, 13935 bp, Homo sapiens
  3rd Promoter of CD86
tcctttaaatgtaccatattgtctactgtgttaaaaatgagaggaactgactcagggtgagagcgatggagtgtccagatgttctcctttatttctccttattcctggaaatgtaatgagaatcttagaggtgaactgaaaagttatgagttcaaccacttactcaattcgagattcgctcctaaaatgtctcttctgtgttatcacccccactttggtttgaatagtacttgtgacagggagcttatcacctcacaagaaaatccagtcattgcttgtagctctctattaaaagttttccatcatctggaactgaaatctggctccctgtaacttttagttattggaactacttgcccttcagcaacagtgtatgtatcctcccatggaagggcccttacatatttgcagacacccagcatatacttgcaatcttttcttcttcaggttcattaccctagtccttttagttgttcttcatttgacataatttcattattcactagtgaaccttgctgcccttccccttgataaaccgaatttgtcagtgtcattcaagtataactgacctcacagaacgtgataccacaagcgatgtggtctgattagcacagagttcagtgaatgaatcctacactaggattggatgaaatttacttagccataccacactaacacttatgtgatttttatgtttactatggatagactatttctcctgtgtccacttcttcctcttacacagttgttatttcaaaactgaagtacagattcttacacttaccctcaggagattcatcatgttagtattagtctctcttttcaggctttatgaatgttaattcagctaactcatttttgagctatctgtctcattttgtgccatctgcacagcataagtttgatttctgttgcttttattagtagttttactaaatacataaaagtgaaatagtgaaacacagagtcttgtagcatccactgtgggatcagtcttttagacaagaatgatgcagttgctgagtcaaatgaataaatgaataaatcaaacaatactttgtcctcatttcccatattgatctatcaccatatcctgttaattataattctaaatatttcttgatctatccacttttcccttacttcacctgctactatcccagaccaaacagccatcttctttcactcaaacaattgcagtagccaactgattggtcttcctgcatctgtcctggcttccctatcatccatttgctacacagaaaccatggtcatcttttcaaaatgcaaatctgatgatatcagtctcagctctaatttctttggtggttcacatataaagactgaaatctttaactgaccaataacacacgtgtgatctggcccctgctcacctcttcagccttgtctttcacctgtctcttcattttggccacagggacctcctcgtaccttctctcacgtgccctcctgcctcagcgcctttgcatatgctgttccctttgccgagaactcttcctgtcaactcccaagcccttcacctacttagcacctacctattcaatctgttctgtttgcctcttggtatgttacaaactgtctccaaacttagcagcttagaacaatgaatcctttaccctctctcacaatgtttggggtcaggaatttgagcgggccttggctgatttttctgttcctcatgccatcaattgatatcacctgatgttattaagctgatggatgggctgatctggagatgcactgtccagtttggtagccactggttacctgaaatgcagccagtcctaattgagatgtgctataactataaaacacccacatgattattgaagatttggtgccaccaaaaaatttaaaatattcgttaataatttgtattctgattacatgttgagattataatatttcacatacatcagataacataaaatgtcattaaaattaatgtcacctatttctttttaatttctttaatgtgactactacaagttttcaaattatatctgtggcttgtaattgtggcttgtattgtattctttttttctgagatggagtcttactctgttgcccaggctggagtgcagtggcgagatctctgctcatcgcaagctctgcctcccaggttcaagtgattctcctgcctcagcctcctgagtagctgaaattacaggtgcccgccactatgcccagctaatttttgtatttttagtagagacggggtttccccataatggccaggctggtctcaaactcctgacctcaggtaatctgcccacctcggcctcccaaagtgctgggattacaagcatgagccaccacacctggcctgttttatattcttactggacagtgctgatctagagcaggagtcaagcagttttttctatgaaaggccacatagaaaatgttttcagctttgcaggccatgcagtctccatcatagctgttcaactcttccattgcactgcaaaagcagccatagataataatttacaatagacatagcagtgttccagtacaactattaataaaaataggtggtagccagatttggcctacaggctgtagtttgctgacccctgatctagaagatccaagattttattcatatgtctggtggcttggcagggataggtggaaggctcagctgggaccattgacccaaacagctatacagtcctctccagcatgatggtctcggggtagtgggacatcttacgtggtggctcagaactccagataaggtactcccagagagacaggtagaagctgtgaggcttcttatgaccaagctctcgaagtcccagaatatcccttgtactgtattctatggtcaaacaggtcactcaggctagcccagattcaaagagaggagatccaactctacctcttcatgggaggaggagtagccaaggatatgtgtttctttttaatctattatatcattcttcagatctcagtttaggctggtcctgttatgggctctcaaagtaccatgaacctctcttttgtagcacttgtcatagctagttttacatttctctgtatgattacttgatcactatcttgcttttctactaaactgtaggcaaccacgtgaagaggaactgtttctggttttgctcattatattcctagcaccaaacacaatgcttggttcaataaatatttgtggaagaaacgaatgaatgaatgaaccaatagcaaatgaatgaatgagtaataactgtatcaatattaatcctacatttctccatattgctgtcacgtatatcataagatactctgtcagaagccttgctaaaattcaaatatatttgattcccagtaaccttcttattttgtagttcagaaactttataaagaaggaaataagcctatcttactcttcccagtatctcaaagagggtttctgccctgagctgctcaagagggtttctgccctgagctgctgttcattctgcaaacactgctcgaatacccactgtgtgccaggtacagagagttcttctctgctgtaatctggacaggcaccagcttcccagcgtgggtttaggcttcaggtgcacactactgtgtaccgtctaagccacacctagaagagctctggggaaatatgactacttgggcagaaaaggaaggaactaagaagaggtatctttgtgtctgaggtctgaaggagcgtgtgggctcttgttcaggcaaagggcaggatgaggggaggtggggtggcagcagccagtaatggggtgggacagcggaatgcagaggatgaaacttcaggtcctggtgctctgagaagtaacgctgtgcagcatgtcacacccagaggcaaaccaaggccccagggagctgatgttgcactggagctctactctcctctcagcgagctggtgacgtgccagtccagcaggcctggcttatccaaccacaagtatgaatcggcagaaggcaatgagctgggccctgagtgctgctgggctgaggccgacctaatccttcctccacagagactgtggtgtcccctgctttgctcagggtaagaactcttgtatacctcacaagaagccaaggactacctaccaccttccacactggccctggagcctgcattgtagttatttgtggacactttttcttctctttagtgccaggtgggggaccaaggcctacatgtctttacaacccctcaatctctagaacaagtctgacactgagtagatgtagcaaatgtttgcctgaaagactacctcaataaataaccttctgaggcaccagcaaacttctcagcatttttcctgatactccggttaccactaacattctacacaaagttgtgaaataagtctttttctttgttgctctccaacatctactgtggacccctcctctcacttcctgtttcatcctctctgcactcccctgtcccaccccattactggctgctgccattccacctccctcatcctgccctttgcctgaatgagagcccacatgctccttcagacctcagatacaaagataccccttcttagttccttccttttctgcccaagtagtcatatttccccagagctcttctagatatggcttagatggtccacagtagtgtgcacctgaagcctaaatccacgctgggaagctggtgcctgtccaggttaaagtggagaagtactctctgtacctggcacacagtgggtattcgagcagtgtttgcagaatgaacagcagctcagggcagaaaccctcttgatgcaaagggatactttggggccccttcttctcccaccccagtctgtctctctgagagtcctctcgattccaggagccaccatcacacctggccctaggctgtgctgctcccgtctgtctcagaggctagataacatcagagtcctttccactggctcctgtggcagagcaaaaactggttggcatttttaaacgtgctacaccagtgtgtgaaagaaacacaggctgcatgggtttaaatctcagctgtaccatttactagctgggcagcctagggcaagtactgtgacctctctgagactccattccttcatctgtaacatggggacaaataatctcaccctgttgtgagcagtaataatatgattaatcatttagccaactcttattcatgttctctgatgggccagacatacaaagtaagtgaaagtggattacggcaggtgctcttcttggtttctggagtgaacctccatttacatggaggctcctctttttagatttctgactagttcacccaccttattcatagaccttattctgtgcttagctgacagaaatctcctctcagagaatccccccggtaaattcttaggttctttcctcttccattcccctttttgctctctccctccgaaggcaagagtttccactttacaggcccactggagaaagttatggcttctggttgtggttggaggttcattcctgagggagtggggacatttctacacttcttcacggccaatgacattggagaaactggcttcctaacccagcccacaccctcgcacacacacatcacacatcatggctagaatggagagaaattcttcatatggggcacttgtacttcatgaaagaaaatcatatcaatcttgagtattttaacatcctattacagcagggtcactgataaactaagtgtccagagtgttttctaggatggtgtgtggtctccaaattaacattagtgaagcttactggaaggattgttactcctgggccaggccaggattttgaggagagatgtgtttgctgtcaccaaatccttgacagactttggcagaagtgtgttaggcttactctggatagcttcagaggacaaaactagtattgacggaaggaaggtaaggagaagcagcttctaacccaggggaagagagagtttccaaactgagaaatcaaaaatggtactgattccttgtcagggtcagtgcttctccccactgtgtgaattacaggggccatttgtccaagattccttagagcaatactgatttcatgtaattatttgaatgaaaggtgatttgttaaatttatagtaaaatataatttgatttgtgtccctgtttgtcatgccaccccagaagaaaaattgtctttggttaggtcgaacataatggttttttggtttgcaaaccatgagcgattcccatattaggtgggagttcagattcaaagggccctcttttttttttttttttttttgtagtagccagcctaatgagtaggaagttgttctcactgtcattttatattgaatttcttttattttgagtatgaccatcttttcaaatgtatgagatagttatttccagttccacatactatctgtacatttcttttgcccgcttttagtttgggtctttggcctttttcttattgatttatagaagctcttttatacatagaaaattaatactttgtgactagttgcaaatattttcagttgctgaaatacacagtaggtgttccatgtaagagctgaacagctggttcctgattgctgtctccctcccttccagccaatagatttcagagtttgggcattacctattgagccaaagctgacaccacacaagcgcagagtatgggaacagagttctctgtctgattcctgtgagcttcctcatactaaatcaccaacagcaacctacttatcacagaatatgagaattgaacaagtgttggcaaggatgtggagaaattggagctcttgttccagttgtcgatgggaatgtaaagtgatgtcgctgctatggaaaatagtgtagcagttcctcagaaaattaaaaatagaatgaccacatgatctagcaattccccttctgggtatatacccaaaagaactgaaagcagagtcttaaagagatattcatacagccttgttcataccagcattatgcacaatagccaaaaggtggaagcaactcaaatgtccatcaaaaatgaatggataaacaaaatgtagtatgtacatacagtggaatatcatttagtcttagaaagaaaggaaattcaaacacatgctacaatgtggatggcccttgaatacattatactaagtgaaataagccagtcacaaaaagacaaatactgtatgagtttacttataccctaagcagtcaaattcatggaaacagaaggtggaatggtggttggcaagagctgagaggaggagagaaagaagagttattgtttaataggtatagaggcttagttttgcaagatgaaagagttctgaagatggatgtagtgatgactgtacaacaatgtgaatgtatttcataccactgtacactcaaaaggtgaagatggcaaattttatgtgtattatgccacaactaataaagatttctaaaacttatgagatctaatttcaccgtttcctattgctaaagatcacaaattagaaaacacgttggcaaaaggtacatgaaaataagcactcttgtgttgatcagagcataaacgtataatctcataaactaataaagatttctaaataacaaagatttctaaaacttatgagatgtaatttcaccatttcctattgctaaagatcacaaattagaaaacatgttggcaaaaggtacatgaaaataagcactcttgtgttgatcagagcataaacgtataatctcaggggagaacaatttgcaactattcttcaaccctttggtcaaacgattctgcttctaggaatatagcttactcccacctgtgtgatatggcatataatcaaggttttccattgcaacaaaagattggaaacaacgttaagtatccatcactagtggtctggaaatatatatatattattgtcatccaatagaatacaatagactaatatgcaacttttagcatgaggatactcgttacatgctgatacagaataatctccaaggtagtcatatgtgtgcaaaaccgtacatagtatgctaccatttgtgcttaaaaataaaaagaaaacagaatatgggtcaatgtttttgtttagttttgtctaaagtaactttaagtagaggcaagaaactggtaacatgtaacagtgatcacccctgttacctctgtggaagaaaactagacagctaagggacaaggctgggaggcagacttgctttccactatttatcacctttatctttcaaatttagtaccatctacatttagtaccatgatctattcaaaaatatttattaaaaaaagaaaaggtatagtctagaaggaaaaaaaacataacagacacttctagcccaatgtcctgcactgggtgctatgagagcagaggaaagaaacacatatggcttctagacaacaccgtctggggcatacatttctgctattcgatcaagaatagttgtgcatcttttcctggaaagaattgatttgtttttatcaacagacctatgaatttagtggacagacctgtgaattaattcactggttaggttttcctttttacattggctgttaaaaagctataagccaaatttatgtccccctcagtgcaaattgggcagatttctagggcaagcatttagcactggccttgtccttggctctgtatcatattcctgtatttggtttgcttttccacctgtttctcatgttggtcatctttcctgtgtatggccataccatcctgaatgtgcctgatcgcatctaatgttggtcacctctccttattctttgcttccttataagccactaagcagcctttttggtgctagttagggtaagtgcgtgggtagtgaaggagggaggagggagaggaagaaagaagatagaggttataaagcaaagcatatcctttttcttggcttcatcatgtagattaagtgaattgctctcaaagcgtggtccttaggccggcagcattgtcatcaccttatgttgttaaacataaaaattcatgggtttcatcccaacttactaagccagactttctgtggttgaggcccaggaaactctccaggtgatttttactcacattcaagtttgagaaccacaggaaaacaaaaggaaggcagatttctaagcgtaaatgcaatactaaccgattgcccccatcatgcctgttatgttggtcaagataaataatactagctactgcaataatcaatccctcaaattttattttttgccaatatcacaatccattgtagatcagttgtgggagaggtgtaaagagagctgctttattagtttattaagcaaaccagatctcttccattgtgagactttgcgattttctaggcccttggacatttcctctggatcccctgctgctaagaaggcaggagagggaggaaagagaagagactttagcagccagatctggaagaaacatcttttctgcccacaattccattggctagaagccagtctcatggcctgtataactgcaggggaggctgggaaatgtgacctatcgatggagctaagagcaaaaggaaatggctttgatgaagccctggcattgtctctgcacacccgagaacccaagtgaatcccaaactccacgtccaggtcatgttttggtgaacatcggttttcagtttccttttctaatcaagttttacctttttttttctcgactctagcactatgggactgagtaacattctctttgtgatggccttcctgctctctggtaagaacctttcagctttgttaagtcctggaatcctactgtctcctgatgagtctgaccacagcaagcccaggcctgagacttggtgggttttactcactttctactgagcattgtacaagaccacatgcaaaaaagactttcctggagaagaaggaagtgttatgattgagagcagctgatggcaggcagctgggatggagctctcccccccgtgtgcttcttcctcctctgcagtctcacatcagtgagcctagatgctcagagtagggtagcctggcccatcccatggggatgggggaaggctgctgcactgaggcccctgagacttgactcttttgttccacacatattctcttctggtcttctctgaccctgtttctgtctttctcaggctcctaggaaacaactgacagaattccaaaagtctcccttcattcggagcactggctttcacgtccctgacttccctaccctctctcactcccttccctacagcccatgcacatacctcatggttgccacggcttcctgacaactatggatgttcagctaattgtgtcagctgatttatagtggagccaatgaagctgaagcttcagagccctccatttgcacaaccctttctaaatccccctcaagaccctgtgaagggccccctagcagtgtggtcacctgtcttatgctttggtaaaatttgaataagtaagatattgtaaccacaataagttatgaccactgtctccttcctctgcaacttttccctccatgccattctcctgtctggtggtgttagcagtcaggggcattttgtatttgaattctacattctttttcttaactatccaccacctcccctcaaaattttaacagcatccagcctcacaaaactcagatcttccctgtttacagttccactttgagtttcagtttcttcatctataaacaggagttggctgcggtccctgccatgtatcctgtgactcagtgtctcgtagttactcctggcccaccccttcctgctgctccttgtctccacctgcaggcctgagagggaagccaccccactaagacagggaggtgaactgagcctgaagtttggctacagcacccacaggccaccagccatgagttcacctcctccagatggccacacaccaggcccttggccactgtccccatgtctgctgtggatgatgaggagtcagggaactacaaagagatggtccctcagatccatgctggctgggataagccttttcagatttctgtttttctgcttagcaccttgagcttgtggagtccttgagtgcaaggtctgtagatgtgccagctgatcactgacttaggtaacaacagcagcttccaacccccagggcccatgacctgctaccttagctcctggggatgtgggaggtatgtgtgtgtcagagagcaaggcaagaagactctagagaacattatccagtaagattcccttctcatcccacttcttatttatttattttatttattttattttttgagacagcatctttctctgtcacccaggctggagtacagtggcacagtcacagctcactgtggcctcgattacctgggctcaagcaattctcccacctcagcctccccaagtgctagaattatatgcatgagccatcgcacatgacttattttatttatttgataaatgcatatatacacacagtcatgaatcgtttaacaacaggggtacgttctgagaaacacattattaggcgattttgtcattgtataatcatcatagggtgtccttacacaaaactagatagcatagcctgctccatacttaggctacctggcacagcctattgctcctaggctacaagcctgcacagcatgttactgtgctgaatactgtaggtgttgtaacacaatggtatgtatttttgtatctgaacatatctaagcatagaaaagatacagtaaaaatatggtgttataatcttatgggaccaccattgtatatgactgaaatgtggctgtgcaatacatgacagtatatgcatatatatatatatcccttactttgtgcctggtactgttctaagtacctcataaatattaactcatttgagcctcacaataactctctgctttaggtcttgttgttatttcccattttaagatgtggacactaaagcccagagagatgaagtaatttacccaagatcgacagagctactaagtggcagagcttggattcacacccagcaatgtagatttagcattcgttcacttgactcttctcctaactcttgtggtaaaccatgaataagtggtaagacttcttccatggggcctgaacagctttggtggataatatagcttctgcctcatccgtgttcatccagtgcctcctccccatcacctgcagctgacacctcagttgacccaagagcttgggcccaagcccttctcatcaaagtgaccagcccagctctcaagatctgggagagaaggaagaaaaatgccctggaaacacatttccagaaaacactaaactggaacaccatttcccaccaaattttctgactccgcacactgaaagtgagaaagtaaagccgagacactctatgaaaactgagttcaggtgtcacttttgcccttgatttgccattgacacttcttagaagtttcttagctcctgagaaaagagttaccaatattgaaagcaacaacctcaaatggtaaccgtttaagttttatggtggtgagagaataagtgactatatttttggcagtacaattttaaagtggaatagaaagcccatgacatcagatcagaaaataacattgccagtaattcacacacgatgaaaagcaacaaaaaatcagattctatttgaattctttcttctcagggcacacctctgcttactgggctggtgaacagtgacctagccacagggccggcttccaaagggagaaaggagatgcaattggcccacataatccaccctcaaaatgtagagctgaataattcatttcatggcatagaaatagcaatacagtgaagcaattctgtttaacttttccctccctatattttgtgtcctctgtcatggaaatttgacacagtagtatttgctgcccctgctcttgaggataaaattggatgggagtttaagactgaaacgggcacctgtggccttgcagaattaggttacagtttgtgccttgtatttacaaagcgaaaggaattcctagtgccacctgcagaggcacttctaactttcaagctctgtttgccactgtcctggcacctccatcacacttttaggctggagccagagaggtttttgaaaaatcagtagctcccacatcaggaggaagtatctttccagtttgagttttggtagctgctctctttttgtctgagggttctctgggtcctagggctttctcatttctcttgaacaacacctctagttaatttcatgtacctggagtggtagttggaatatttcttcactttaagattttttttttttttttttgagatggagtctcactctgttgcccaggctaaagtgcaatggcatgatcttggctcacggcaacccccgcctcccaggttcaagtgattctcttgcctcagcctcccaagtagctgggattacacctaccaccacaaaatacaaaaatacacaaataatttttgtatttttggtagagacggggtttcaccatgttggccatgctagtctcgaactcctgacctcaggtgatctgcccgcctcgacctcccaaagtgctgggattacagacaggcatgagccactgcgcccggcccaccttaagatttatgtaagattggctcaaaagctcattcctgtggaaaggtccactgttttcctcccaagatttttgcagatatctgcgtgggtggttacttttgactcccatttcctgctgttgttgatagccctcattaaaaccatcacctggaggtgaatagacagtcgagacctatcattcccaaagaattgtcatggagcctaatagttctattggattcacccctttatgttaagccaccatttcagtgtttttcaaaatagatatatgttatctagtagggagtatcttacccccaaattagttgattgtttcaggagggcttttagtgggttccagagaaaatgagcaatcagacaagttgatttagtggaagacagtca

SEQ ID NO: 214 - DNA, 13735 bp, Homo sapiens
  4th Promoter of CD86
gtaaatttatctataaattattgattttatgtcgatagacattgttctctatcattaataatgttaaaaataaataaaaaaacaaaaacaagtaaatcaattaatgcttaccacaggccagtatttgatccaacactaactcaaatattcatttctttaatcctcacaacaaacctatgaggtaggtaccattattgttcctgctttttgcaagaggaaactgagacacagggaagttaagtaatttgcctatggtaacacaggcagtgagtagttgagctgagattgaactcacgctgtccagaatccatgctattagttataatagtgtactgccctatagctttctgtttcacagctacatggcattactttgtatggatgtatcattatttgttaaaccatttaacttatttccagtgtattgttcttataaacaatgaatacctgtgtacctctaattttgtgcacatgtatctttttgtagaatgaattcttaagaaattgagttgctaagtcaatgcttaagcccataattaattttcttacatattaccaactgtcctccaaaaaggttgtaccaatttagaattttaccagcagtaaattcagcagttaggacccattttcctaacactctcgcggacactgggtattaccagtattttttttaatacgtgccaatcaaatgggcaaaaagaatggtttctcactgaggtttaaattgcatttccctagttattcttgagatttttcctttcctttcttcaacaattacttattgagtgcttcatatttgtaagggacaattgcaggtactggaaatgtcacagtgaggaaaagtgacaaagcccctgctgtcatggagcttattctaatgggagatgtcaggtgctcagctgagctgggagagagagagctgagttgtcaggtgtcagaggagccaattatagcagcaaaacaaaaataaaatagttcagcttttaatctcttactacgacggtataatcaagaggctaaaatgggaggaagggcagactctgcctgttccatttccccacatagagtgagtataccagtcgagggtcaggtaatcagtgcagacttagggggtcgccttaccattgaagaagccccaaatgaaaggctctagcagttttatggacctgggggtggaggaatccaagggtggggagaattcatgaggaaaatgaggtgagagggctaggagtggaaaagtacaaagtactgagttagcgtggggaatagtgtctttagggctaggagtggaaaaaatactaggtactgagtcagagtggaaaacagtgtcttcaaggcagggagtggaaaagtgctaggtactgagtccgagtggagaaaagtgtcttctctatgatgaggaggcttcagcagaggtgcctgaagacctcaccccagagcctcagataaagagacctaagaatgagggtgcctgggctaagattgcaagtatgtgaaaaagcatgactggcgggaggctgagatcttgattgcagcccccttcagagactgccatgcactgactgtgcaccaagtctgctgtagaaagggcaacttcctcagcaaggcttgtcagattaagcctctttaattgcctgtggtcaggtctgaaaaatcacacatagatttttaatcagaacccagacatctcaggagagacagacaataaccaaacataccgtgtcatgtcatgtcatgataagtaccacaataaatataagtcagcatgagggacagaatgcccaggatgctatcttcaatagaatggttagagaaatctccctgggaggtagcatttaatgaaagacctacatgaagtgaaggagaagctatgagactgtctggaggaagaaccttctggacagagggaacaacatgagaagaggacttgagacagagtgtgtgatcttttggaggaatgtcaagggaggcagtgtggctggggagagtaagcaggggaaagaggcctgataggtactggggacccaattacatgaggtcttgtaaggccaggggaaggactttggatgtagttctcagtgtgaggggaagggatctggatatatttttcagtttggtggaaggcatcagaggcttctgaacaggaggattatgtgattggagctgtatttttaagggatcattttggcttgagaaactagacccggggacaaggacggagcaggcagatgagttaggagacaattacattagtctcctctacccttttcttaacatattggagttcagctctggctgtagtagttctagatctcctcagacacacttgtgtagagcctctgttgggtattttgggtacacaaatgattcatcttggttatacagatgatttagatgattgtagacagaagagggttgtctggtcattcccagacaggggagcattccttgagatagagtagaggaaggctgaaggggaggaagacagtacctgttgctatctagatagagacatccagcaggaagttgaatacaggtatctgaaactctagtgaaagttataggctggcaataagcacctgggagttattagcttttacttgacagttgaatccgtggggctagaggagaaaaaccaggaaagtatggagaataagaagaccaagaacatgcactcaaggttaccaaaattaaagagtgatttgagaaaattaacaaggaaatcagagattgggaaagaatagagcatttcaatgaggagagatgccaacacttgcatttgacacagcggtcaaatgagttgagatctgaaaagagctcaagccttggccatggtgtgaagtcaccaacaacctttgtcagggagtttcagtagagaggtgggggtgggaggctgggaataaaggcagcaattgctgcttactctttcagggagtttgactccaagggaaagagaaactaaaagcagtagcacaaggtttgtgtttgaagtaatggaggtgaaccaggtgaatagcctggaggccgagtgaagtgagacaggacactgcagatttggaatgtcaccagtccgcacaactgaataatttcctccagaactgctcaattgcccagttgtaagaacagatatgtagaccaaaagtagagtgtccccagggtaaattttatagagacaaaggggtgtgtttattgaagttgtggaaaggaataattacaaagacatactattgttgcattgtccaatataataaccactagccatatgtgactacttaaatttcaattaattaaaattaaataagattaaaaattcatcttctcagtcatactagctatgtatcaattgctcaatagccacaggggctggtggctatcatattgttcagcacagagacagagcatttccattatcactaagagttcttgtggaaaacactgcactacagggtctggataaagctgaggtcttgattaagttgaacaacagttgtagaaggagtaagcaagagcaaaacctggatgaataggaggttgtggacggagattagtatattgagattaagattctagggactgagctgctccaggtgaaaagtttcagggttatgtcataagaaggtggggggcagctgctgaaatagtctgcgggtgtagacctgtggagttgacaagatcaaagaaatttgaggcaaggttgttagactcattcatgaagaagtcacccaaattgttagcaagaccttgcatctaatgccaaaatcctcatttagcaaggtggtagtgacttagtagctacaagcaatgagaaagtcagacacctcaaaaggggaaggtgttgctcaaagtccccacaaagtgtgataaaacaaacagtagctggggctggagcaagtggcttcctttgggtgaagccagatttcactgaaataataacctcagggaaacagtcaatgaaggggttaaagatgtgggagagtttccttgtagtaagtaatggaatgaggctttcaaagggccaagtaaaactttggaggaagtttagtaaaagaaggaattttttttagtacagataagcataggaacataaagaagagataattcttaaacatataagatatgcatttggggatagcagccagggaacactgaagtcccagtggggtcagagacttcataaggctagcaaattacagtttttgagtggcattccaacagtagagtgtattgctcaggaagtccttaattatcctttgaaacaaattccttcagctgattacgaaggcatctagctggattcttgagcgacttgttcctgacatcatagcaacccattgtaactagacttcgaccattcctcttacccaagtgctggggaagggagagattctcaatgcttacccacctatggaatcccagtaagtccagttgctaggtggcttgaggtctggggtcataaaatggaaggcctgaagtcatttggtgatcacagaccttgagccaaactttccccatttagtcagagaaaggattagcagcatcccccatgcctggctctgtgtgagatcatggaagccagtggttggtgaggtgctatggagtataaattgcaaaatactttcagttccactcagaatggatttcaaagtgatttccaccccatggggaggagagggagtctgaggagggatggatggaaaaaaaattttcatgtcattttctgtgatccactctggagacagaggcagagattctctacaacagctgctcaaactatagctcttgttaaaatggaggttctgaatcagtaagtcttgggtggggccagagattccgtgtttcagaccagcccacatgtgacgtgaatctcattggtccatacatcacactttcagttgctaggtgaagaagggagcactcgatgagtggaagagaaagccgttgtaatctttgggagaaggggcctgggtcagcggagttagactggtctgtgagtggacagaatggatgggaaggaaagaagatactgtgaggctctacagaaaaaaaaaaaaaaaaaaatatatatatatatatatatatatatatgtaaatcaagaagacagaagcagctaaagacgaagtcatttccaggtccagaaggcacaactgacagctgagtaataacataacattgactgttaattggcagaatttttaactgtgtgtttggtttctccatcaggtcatctgtcctatattacatgacaatttagactaaaaccagtatttcctcagagacaatgctagaagcttttacagtagggggcactcttgcattacattaagagctcagcaaagaagatgcagaagcctcaggtttgccttgtaaggtgattcataaacacactaaatcttccttaggtctccctttcactgtcagggtacgcatatagattttccttcctccctccaataccggtacgcatcctctacaggtggtgcattttatacctcaagtacttcacagggtcctagtgagtgtagtgaaataggcagtgattcatatttgtgcaaactcccactgatgcctgctgtctgcttccctaagagttcaagaccaccaccaaccccttgattatgtgttctcactgggccactctgtacacagtttagtttgacaagtgcatgtcactgttatctgtccttctattccctctttcaagagaaaccacatcaatttaattactcccccacttagaactcttcaaatgaagctcctctcatctctctcatcaacccatctcctccctttcctcctcaatgtcaacatgccttcacataaatcctgaatgatgaaattttatttagaacttacactaacttcctctccaaggtggcatctaacttcatattaagtaagaaacagccttcccactctccacccccgcacttctcacccaccactgcttactttttttttttttttttttttttttttgccaagtctcaagtaattctgtaacctagaaaaggtcctacacaaaccccgtgatcattcacatttaagtagttgggtggcccacatccttcccacaaaccccaaagtgtcctcaaggactaaagcctttctctcaacccttccagcatgatgtctatggttgtaaaattgtccagggtcagtgcatactgggagcagcaagtttgtggtgcctggggtttccccaatactcccaaagcacatcctcacctgcccatctatgattcattttcagcatttcactcatgtgccttaaatggtcattgaccaccacaatccgaaaacagccatcaaatttgcccagttctctttctgatctctgaaagagcttagagaggtcactgaaaataaaggccttggttcactatcgaagtcatttctaaagcatttgacatccttggaagtgctggccatgggagcagcagtcataggggaagttctgtaaagggagctatttgaatttcaaagatgttactcaacgtgattccccaactaatgaagtataataaaggggggctataatttattaccattatcagcaatcttttcaccatagcagaccaaggaatatgtggatgggaggggaggggaaagcttttggtgatggtgtagaagttatggaacctgtaacagctacagtgatgaaaactaaaattaaggttataggaaggtaactggtgggtgaatgggttgtctaactctactggtttttccctgtcttgcaatttaaattcacagaaccacagtactagaaagacccttggaacatttagtcaaccacttcattaatcagatgaggaaactgaggctcataaagattgcagtttgtacaaggccacacatttagtcagcggtgaagcaaggacaaaggtcctaatctccagatgccaagcagatgtgcacagttccagagcttaatatcttattcttcagcatgattactgataagatagtatctgggtattgtataaagagaaatggaggttttttcccctttcctcttgtttctccctccctaatccttaaccttcttttttaggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttggtatgtggtcaatggtgtgtgttcagattcttagccttctcagatgagactgcaaatgagttagaaaaacactggagggggacttgaggggcccaggggaaaaggggggtctatagagagaaggcagaggacagccacttctgggaagtgcatttgaagggagtgtagagtctgggagtagggaactgaaagtcttttgtactttttatagtctgcttctgaaggatcagtaaaaatctgctttggggaaaaaatagagctaattgaacaaagataatatggctaattacctatagtaaaaaccatggataatttggccatcacaaagtttatataaccataaaggcctcagatgtcttacattcattttttccttgggtccaagatttttcacctactaaatctttgcctggagctcctagcaaagcggacagctgacacatttgggttttcccttcagcctcctctaggttgcttatgagttgtttgctgccacaaccatgagcctggtagacagaagggaaaaaaacccaacaaacataacccacaaacttacaaaccagctcctctgcttcacgagaccttggaaggcctaaatgccactacagatttttttaaaactatcacacagtaaaattatttttttttgttttgatatactgttctactgattgtatagatcttgtatagatttaggtaaccgccacaggacatagagcatttctatcaccctaaaaatttccctcaggctgtcccttcatagagtcataccctgtctgcactcataacccttgttgggcatcctatagttttgtctttttgacagtgtcacataagtgaagccacacagtatgtaaccttttaagcctggcttctttcgtttagcgcgccttcgagattcacccaagttgttgcacatatcgagcttgtccctttttattgctgagtagcattttattgtttatccattcaactcagtaaaagacattgggttgtttctggtttggggctcttatgaataaggctgctgtaaacgttcatgtacaggtttttgtgtgaacataagttctcagttctctagaggaaatacccaggtgtggtattactggatccaggttaatttttgatgaaacttgaaaaggcagatcaacacctattctaaaaccatagagtaaaacagaagcaaaagtaaaaatagaatggagagctgctccctttgaaccctgtgtgatttaaactaggctgcagggctttaggaatagttaaccaagtgctaaatccgtgttttcaaaatgtggtcaggtaccattggaaatgttttaggtgggacacagataagcattttgaaaagccatgttgtatttgttttaatgtatattagaaaaactctaacttacgcaacatgtgatttcacagatcttgttaatgaagctaaacacggtctggcaattcaccttctacaggccacatagactccaagaagactgctcaaatagtacactgatatagcaaaacttataaagatgacatgcaaatgacagaccttttagtaagaatacactaaattataaattagtttgtagaacctgcaaactacctagtaactataaaagaacaagggattttttctgacagaaggcacatgacacaggtctagggactccatgccagtgatcctgaacagccagaaaagtgagaatggcaaaggcaagagaaacactgtgtttattaagatcatgtatttttccctaaaatagctggatttggccttcttcttagagtatgttatgaagacactttgatgctcatgccaaaaatcagtgttctgaatttcgaattccaaaatatccacccactcacttaccacaatcctgcttgggtttctgaaagatatgacgcagggcatctcagcaccatgaactctgtcagttcctggtgagactccagctcaattccttcctgctctcttagtctggggagctggaatgtgccccatgggacacctgggccctagagtcagaccacttctccttccaaagactctactccctggaaacagtggcttcattgtaaatctttggtgactcaattacagccctcctgtcacttagagagcacccctttgatttggataagcaggaagtaagcatggctgcaaactctattgttgaaaaataaacatgaagtcattatgtggcactcaccttgggctgagggtcacattttagacaccctgaggctcccaggtgtgccccaatgagccccagatcaagtacccagttatttgctattccctcctagatacatctaaacttagattgatttttttttatctctcttctgctttcagctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctataggtaaagctgttttccaagactatttctttcagcaggtattatacacaaatgcttaaggcagatcatccaatgtccccgacttgctaggaaacctccaactgggccattttatgacgctgttaggaaggacccagatggaggtctcctgcttctcctgagtgatgcagggtccaggaggctacgagcctatgttgcacttgaagaaatatgcttttagccctgaaactgactcagtctcttggtttacctttggatggaggattctgaagttttgatttaaaaatacaggattcctccaggctagaattctttctttgattacaacacatacatgcgcttgcacacacacacacacacacacacacacacaccatgcatacatgcagacatacaaatgatatttattgtgagtatagaaccatttgggacattattggtcacaggagtgaaaacaaaaagatatgacaccccctctgcccttgaggaccttccaatagaatcagaaccctgtaatgtgcacacatgaaaaactggatttttaaaaggttgaattggaatctaaattttattccatggaaatatctgactaaatttaaaataaaagtgactggtaatgagatttatgggcattcagaggtaggcaagatccctgagggtcagggaatggttcctaaaggaaggggtaccttgtaacatgtaaaataaattattggggttaataaatgtggtgaggaggggagggcattctggatgacaggttcccaaaactgtggtgacttccgtagctgaaaaaatttgagacagtatctgggctaagcaggtgagaggaccacagtggatcagctgtatctgacgtaagtgcaggaggtatgtcaaagaaagccttggaggcagaaatgcttgtgtgttcacaagtattcttcagggacaagttcagtggaggaaaggattgaaactaagcagtagccactaataggagcctgacattttaaagtcctggctttacccaggagggcatgtgtctatatttgactcctcttttaagaagctgtaactgcaagattccctcctggaataaaggtggtctgcatctaccctgtcccatcactgcctgtgctgaccttgacacccacatctgccttcttcttaccttgaccccttctccagcggtgatttcttggcttgccccctccagtgacatccatccaactccttgctccataccctggctttgtcacctcctttctcccagtgtcttgttgttcagatataacttggtctgtgaacagcccacggggccagtccccatgaaccaactttacaactgggccaatctcatctcctgctactgacttcttcctattcagacacttcagcctctgagaatccagtaaatggtggagccaactcgtcctgtcccagttgcttctcctgtatcctctcttggccagatagaagcctctccaagctatgcctgaagttcagtacctccttcaatgtgtaattagtttgattggtggccacaagatggccatatatgacatgccccagggccctctgttacggctcccatagtctacaaattaacaggggcttgccaccactataacctcatcatggctcaccttcctgctgcttctcaactactgttctgccaaacttcaacaggtacccccatcttcagaaatgtttcagctctagctgcctcaggaagatggggcttgcctctctgggtttcccattctatcgcttgatcagagataggttagaccctgagtcaaggggccttttttgcatgttaaaaggtagcagcctccacgttagtaagtataacccctaaccccctttactgggagtgccaaactggctcaagtggaatagactgggacagactcaaaagggattaaatatggcctgcaatgccaacaacttcttaacatcccagaaacagggcatgtgtctacaaattatagctaagctaatagatcagctggtcctaattttcctgaaatttgggattagctaccagaactgttcccaaaaatgtctttaaagtgggcgactccgttctaagttttccccacaaagcctgttttccaactccccagaaacttaggagttctcatgtaaggaagtagttcctgaaggcgtgaaggttcctcaaggcatgaagaaacatcaaaggtttttcagtagatgagatatgctgaaagccatgcagaggaaacctgctgtgacctcagtaggaaaaaactaaacaaacaagcaaatgaaaactagaggtaggggcctgtggaagctgttccatttgtccaagtgagaggtgtctggagattatagtggacagaagaatcatcacgagaggaacttcagggcctgggaactgactgcagaggggggcaggatagcaggcacggcacaaatgactgcacgtgcagagcctcagcacagacacctcacccagattccagaatcacgggccaggctgaccctcttcttcctgatcatggtcggtgttatccccacctccatgaaggcatggcagctcagtccaggcatttggccagaggcatgggctcgattcttaggtcgctgctgaggccctgagcctgggactttctatggcctcctattgtggatttcaggcttctctggccttagagccctggggagaggctggcaggtaaataaagagaagagcagctagcagaaaccttttgtaaatgactctcctggctgattgaaaatttgtggtcatttgtagagcttgaggaccctcagcctcccccagaccacattccttggattacagctgtacttccaacagttattatatgtgtgatggttttctgtctaattctatggaaatggaagaagaagaagcggcctcgcaactcttataaatgtggtgagtgagtccttgtcctccccacagactgtcactttgcacctacttcccaatcggctggctgccttccggagcttgttggctgagcctagactggcaaaaagtcaggaagttgttgggaaaaaaggttttcccttggagttttgagcctatacagactggcagtagcagataatgctgctcttggacttcaaagaaaggcgacatttctaacctctggtttacaaatgtacttctggtttccagggaaaactgattattacttgctttatctacctcacttcatgaggttactgtgacatatacataaagtaaaatggtgaaaccactcctaaatgttaaagattgtggacctggtggtgtttaagcagggatatttgctaaatgaccacaagaatcagcttctcgtctctaaaaaaatctaggtttcttatgaaataagttagatgaattattgcccattgacttataacaaacaatattaactttaactaatttctaagtaatacatatccattatcatatataccaaaaataaaataatctataactccactaataagaaaaaatgattacacaaatatttttggtgcctatctttaagatttttctgtgtatcaatctatgttgttttccataattaggattatcataagggttatttttcacaatttggataatatatgtactgtgttctaattttgttatactaaatgtagcaagacaattttcaatgtcataaatatcattctacagcatcatttttaatggctgcaagatatt

SEQ ID NO: 215 - DNA, 6481 bp, Homo sapiens
  1st Enhancer of CD86
atcacctaatcttttcttctatttctccagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattcatttaaaagtctacattttctgctttggcttcaagagtactactcaacccttgtggtctgatgttccctgctctgtcctctgaatgtacttcctttctctttacatctctatggctagaagcctctcacgcatcctgtatcttctcctcctcccttttccctaccattatttgagaaaggaggcttgtatacttctatatgtttatctcagtaataagtcataaaaaatcaagtaagaatggttgtttttgaggacaactaagaaatctggaataaggaagggaagcttacttttgagtttgtaacctgtagtgtgtaattttttaattatgtacttacatgtacattaaacaaaagcttaatgtaaaaatattccttgaaaacaccatgattataaaataaatgcatatatacacatacagcatgtgagaggagccaggaaaactctggaaaaaagaaaattacctagactctgtgagggcaggaatgtgtttaatttctctccaatggatcctcagacaactaagatagttgtctattctattgtccatctttttgtcttttgttgtatttcttaaagattccctcaactttatcttctaacttctgttgtatttttatttctgctatcatgtattcttttcagaattcttttttgttctctcaaaacatatctgtttaaagattgaatgaaatattaacatgccctttggtgagaacatccctcctttgtatattaaattctctgaactgctgtattctaagactaggggaaagaaaaagaaggttgaaagaggtcattaggcagaatagtactagctaacattatttcacatttaccatatacccgtcactcatctaaacctttaaactcattatcctatttaatcctcacaatgaccctgtgacgtaggtaatggaatattatgcccattatgctgatgagaaaatataaacacagagataagtcagagtaatttacccaacattgttaactttgtaagtggcagagctttgtaacaggcagaggttggaacagtttggagggctcagaagaagacaggaagatgtaggaaagtttggaacttcccagagccttgttgaatggctttgaccaaaatgctgatagtaatatggacaatgaaatacaggctgaggtggtctcagatagagaagaggaacttgttgggaactggaataaaggtgactcttgctatgttttagcaaagacactggtggcattttgcccctgccctagagatttgtgggactttgaacttgagagagatgatttagggtatctggtggaagaaatttctaagcagcaaagcattcaagatgtaactttcgtgctgttaaaagcattcagttttatgtattcccaaaaatatggtttggaattggaacttatgtttaaaagtttggaaaatttgcagcctgacaatgtgatagaaaagaaaacccattttctgaggagaaattcaagccagctgcagaaatttgcataagtaacaaggagccaaatgttaattgccaagataatgggaaaatgtctccaggccatgtcagaactctttacagcagcccttctcatcacaggccaagaggcctaggagggaaaaacggtttcctggccaggcccgaggccttgctgctttgtgcagttttgggacttggtgccctgcatcccagccatggctaaaagaggccaagatacagttcaggtcatggcttcagagggtgcaagccccaaggcttggcagcttcagcacagtgaacctgcaggtgcacacaagtcaagaattgaggtttgggaacatccccgtagatttcagaggatgtatgggaacacctggatgtccaggcagaagtttgctgcaggggtagagctctcatggagaacctctgcaagggcagtgcagcagggaaatgtggggttggagcccccacacagagtccccactggggcactgcctagtggagctatgagaagagggccaccatcatccagaccccagaattgtaggtccaccaaccatgcgcctggaaaagtcaccgacactcaatgccaacccatgaaggaagtcaggagggggctgtaccctgcaaagccaaagaggccaagctgcccaaggccatgggagcccacctcttgcatcagcatgacctggatgtgagagatggagacaaaagagagatcattttggagctttaagatttcactgccccactggattttggacttgcatggggcctgtagcccctttgttttggcaaatttctcccatttggaatgggtatatttacccaatgcctgtacccccattgtatctaggaagttactaactttcttttgattttacaggctcataggcggaaggtgcttgccttgtctcagatgagactttggacttgggacttttgggttaatgctggaatgagttaagactttgggggactgttggaaaggcatgattgtattttgaaatgtaaggacatgagatttgggaggagccaggggtgaaattatatggtttggctgtgtccccatccaaatctcatcttgaattgtagttcccataatctccacgtgttgtgggagggacccagtgggaggtaattgaatcatgtgggcagttacccccatgctgctgttctcatgatagtgagtgagttctcatgagatgtgatggttttataagaggcttttctgccttttgcttggcatttctccttcctatcatcctgtgaaagaggatatgtttgcttccccttccaccatgatttaagtttcctgaggcctcatcagccctgctgaactgtgagtcaattaaacctccttcctttataaattaaccagtcttgggtgtgtctttattagcagtgtgagaaggaacaaatacattaacccaggcttgaaagcaaagagtcatctctgatgactgcattcaacctttccctcagcacccactgctcaccccttcgctcctgcctcattctgttatcagtcatcactaggccaggaaagcattcctcccactttcacacccacctcttattttctcattcaggaccttttttattcataccaaaaacatgtcagtcacctcccaactgatcccagtctcctatctctcttacccttcattctgtccaacacaccaagagaaacaagaaggtaaatagtgaaaaggtctccctcacattccctttccctagccacacaactctgatctccagcttcctgggtatccattcgtagtcacagtatgcctatttttaagtgtgtgtacacacacatacacatattccccttactcaggcagatttggttttactttacactacagtctaaagaaatcagaatactcttgctaggatgattgacatcagtcttcagtgtaatccttcatattaaaaacatacatctgtatgtataagttttcattctcaccaatattctagcatcattgtggatcttataataaaagtgagattccattggattttattatgtctacctgttcacttcagaagaaaagatacttacagatatagaatccttcactgtccttagtcacaaagtttaaaacctgctccaatctgaacaagttacaccctaggtctggtgagcaacagttaccctgaagggatctcccaattcctatgtccatatagttgtctttcttgatttaccccctcactttggtggtgcatatccttcagtagcttgatccagcagctttctgagaaaggatctgtgggaaatatatttaatgaaattttatgtatctgaaaatgtctttatcttactttcctgcttaactattaataattttgcttggtataaaaatttgggttggaaattattttcattgtccatagtttccagtgttgctcttgagaaatctacaaatattctgactccttatctttttacatgaaagcttttagaatctgctcagtgttctaagattttgtcatgaaatgcctgtttgtccattgtgattaacactcagatggacttttcttctggaaactcatgtcctttcctccagggaaattttcctgaattatttcattgattatttttcccctctatttcactagtctctcattttagaatgtcagattcctgaatgttgaatctcctagactgatcctccaattttgttattttctctcctgttgcccatattttgttttttgttccatttcctagagattttctcaagtttatcttccagcctttctgttgtactttttacttctgctatcatgttttattttcagagctcctttttgttttctgaatgtttctttttgcaaggagcctgttcctaatggttgaaatattatctcttaactctcttaggatattaacgattaggttgtttgtttttaaagttttatattccaagttatttcttcctgtttgtttgctttgatctatatcatccatgttaaaggattcccagctgtctgatgatacttgactgtctgttcacaattaagagtgaaaaactaaaagtttggaggatctgagtttatggatgggtttgtcaactttagcttcatggtagagggatctggagcaagacatttttaggaaatcatttttagatcttcttttttgagctggtaatttttcagtatcttgcttggaaggtagaggtatagctgctagtattttgggagccaagtgagagaagaggggtgggtgtgagtagtgatggaacctctgcattcctta

SEQ ID NO: 216 - DNA, 10983 bp, Homo sapiens
  Coding Sequence of the KIR2DL4 Gene
atgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttggtgagtcctggaagggaaggagcaccagggttacactatgggcctgcagattgggtgtctccccagcagagagccatgttctgaagcaagtgagtggtgaggatgagttaattttcagtccagcgtggcgcccagtggctcaggaggaaagggtaggttgctgccgagatgaatagttcatcatgatctttctttgcagggttcttcttggaccagagtgtgtgggcacacgtgggtgagtccttccccaaatgatgggttgccatcttcaccccaatacaagtgaattttccagaaatgggagggaggcagcacagagggtgggctgatgggctgaccatgggaaggcctggggggagtctctcatgaactagtaagaggagatcctgggagtctctcatgaactagtaagaggagatcctgggagtctctcatgaactagtaagaggagatcctggtatgctcagccctctgttttgtcttagccctccccagcctttcttccccatggctgagttgagctctgtgtggcccaggcgggatactgaggtgctcaaagctggggtgtgtggggggatgtggtgtcaccgacagaggagggaagggtagcagtgttaggaacagcaggtcctctgaggacaagagggtaactcacaccctccagcgtttccatgacggtaggggctgcagtgtggctgctgtcattctgccagaagaggtgggggaaccacagccacgaccctgccattccaaatcctctgatggagctcagttgtttattgtggttcaggcattagctaatattccattcacaaaggtcataccctccaccccatgtctactttgtgttctttggtgtaactaatcttgcagtattaaaatctagtaagagtcccttactcagcacctgctcagttctcaactgacacttttgttgtagggagacgccacgtctatgcgggatgggtccttcctgtagccccaggcacccaggtgtggtaggagccttagaaagaagaaatggggagaatcttctgagcacagggagggaggggcagctcaacatactcctctctgaggcggcatctccttctccccaaggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtcagagggctcctgtctgggcttctccttgtcccacctcctgagtcccagagcttctggtgggggtgtccaccagagtccgatcatccaggccccaactatatttggggtaaagggggattgaatacaggggaatgggtgctgtgttggaaagaataactgtccccatcgatggccacattgtaatccttggagcctgtgactatgttatagggcaggggactgaaggggaagatggagctcaggttgttgatgagttgaccttgagatggggagatggcctggactctcccactgggctcagtgtaatcacaagggtccatatgagtggagaaggaagaggagaatggggattagagcagcatcgtgggatactccaccagccactgtgggctttgaaggtggaggaagaccacgagccacgaaggggctggagaaatcaatggaactgattctcccgagtctccagagggaatgcagccctgcagatgccttgattgtagcccaggaagaacagggtctgatttctgtctccagaagtggaaggggtcagtgtgttctctcctgccgccatgtttgtgataattttctccagcaacaacaggaaaccaacacaggaacccaggtgaaggacaagttaaaaaaccaaacaagaaggttggctaccctgagatcagcaagggtgcactgctgatgccaccaccaggctggaaccacatagggagggatcgacaggaagagttgggggtggagggtgagagagagagagagagcactaggccatagagcagggcagtgagttctcagctcaggtgggaggggagctgtgacaaggaagaacctccctgaggaaactgcctcttctccttccaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggtgaggaaagccaatgtctgtcccatgtcctatggtcctagagccttagctgaggagcttcctgctgatgatggagagaagcatggacagatgtggagagaagatgcagcatggtgtgagggtgggatcagggcacaggatggcagacagggcacctccaaaccctcctgcatggcctgcatggaagcttgcagtaagggctccgggtacccaggcagatggagaaagtggtcaggacagacccagaggagggagactgggctcagtttggggagatcagaggttccctcagcccctcaaccttacccatttcccagaagcccaccctggcctctcacctacacagagatgtcatcaccagcaacccctacactttttcttttcctttgaaaaaatgctgattgaggttaaatatacctatataatttatcaactttaccatttttaagtgtaaaatctagggatcataaatacctttatatgctgtgtgcggtggctcatgcctgtaatctcagcattttgagacgccaaggcaggtggatcatttaaaatcaggggctggagaccagcctggccaacatgggggaaccaatctttactaaaaagacaaaaaaaataaaattagccaggcatggtgccaggcgcctataatcccagcaacttgggaggctgaggcgggagagtggcttaaacccaggaggaggaggttgcagtgagctgagatcatgccactgcactgcagcctggtgacacagagagactctgtctctaaataaataaataaatacttttatattcttcttttgttaccctccaccccttccttcctaacctctggtatccaccattctactctctaccttcatgaggtccaccttttacatcctgcatgtgagtaagaaatggcaatccttgtaatgacctccagtccatccatgtggctgcaaatgacaggacgttactctttgtatggatgagttgtctccattgtgtgtatgtactactttctctctatccattcatccactgatgggcaggtaggttgactccacatcttggctactgtgaacagtgctggaacagtcatgggagtgcagatgtcacttcaatacactgaagtccttttctttgcatttacacccactagtggaattgctagatcctctggatgttctctttttaggttttgttttatgctttttgtttttttgacatagcgtttcactcttgttgcccaagctggagtgcaatggcaccacctgggctcactgcaacctctacctccaggattcaagtgattctccagcctcagcctcccgagtagttgggattactggtgcccgccaccacgcctggctgatttttgtatttttagtagagacggggtttcaccatgttagccaggctggtctcgaactcttgacctccagtgatctgcccacttcagcctcccaaggtgctgggattacaagcgtgagacacagtgcctaatctctttttagtttttaaggaacttccatattcttctcctctgtaatggctgtattaatttacattcctatcaacagtgtattagggttctcctttctccaccaccttgccaacatttgttttgtctgtctctgagataaaacccattgtaatggggtgagatgatagctcattgtgacttcatttgcatttctctgatgattagtgatactgagcactttttcatatatgcaatgtatatatgttcatttgtatgttttgttcattgagaaatgtctgttcaggtcttttactaattttataattaaattattagttttattgaggtgtttgagcttcttttatattctagttattaatcccatctcagatgcatagtttgcaaatatttgctcccattctgtgggttgtctcttcttcacttcattggttgcttcctttgcggtgcagaagctgcttgatttgatataatcccaatggtctatttttttgttgttgttgtgattacttgtgtttttgaggttttaaacaaaatgtcttccctcagacaaatgtcctggagcatttctccagtgtttccttttagacatttaatggattcaggtcttaagtcattaatccattttcatctgatttttgtgtatggtgagaggtagaggtgcagtttcatccctctgcatgtagatatccagttttccctgcaccatttattgaaatgactgtcctttccagattgtagattcttcgaacctttgtcaaagtccattggatgtaaatgggtggattacatccgtgttcttcattctgctccattgttttatgtgcttttctttatgccaatgtcatgttgttttgcttactacagctctgtaacatatttttaagtcaggtagtgtgatgctcctgttttctccttataccttgaagtctcaagatagttggtgtcacctacaatgattatggagaatgggatgccaggactcccagggcccaacattagataatagaatgttggccatgaaccaacctcaaagatttccattgagtagaagacaggcatcctcattgccacacctctctcctgtcccgtgttctaggaaacccttctagtagttggccttcacccactgaaccaagcttcaaaactggtaagtgaaggacccctcttatctctgcttttggaaacctggggaggtagaagccttggattcaagcgttggctcagcacctgccagctctgtgattgtgggcctgtcttccattgtctctgaaccccagacactccaacagcgaaagggatctgggcccagcacagggctcagtgaaatctcttaatctctaattttctgctgctgagacctcagggtagaaggatgagtgcaaatcagacattcttctcaggaaaaatgctgtgtttgttctgcctgcattcctaactgggaggacaaatgcctgggggcttgagaaggggaaggaaggggaacatttttgagggtggtgtatttgtagagaagttctacttgccaaggaatgagctcctgtctgtcatgatccaaccctggttgacttagtggaacaagagctttgcggtaagagagaacgtagttcatccgtgcacatgacacttccacttactcgttcagccactgccccatgctcagactgtgcagtgtggaaccttttcctatgttgccataacaaatttccacaagcttcgtggatggaaaccacatttttaaaaaatatctcatggtgctgtagctcagaagtatgaaatgcatcatctcactgggctaaaatcaaggtgacagcaaggctgccttccctctgaatgttccaggcaagaatctgcttcctcacttttcccagctcctagaggctcccacattccttggctcctggtccccgtcttcctccctcaaagtccacaaaggctggtcacgcctctcacacggcatcactcagacccttcttccttgtccacacctctttctctgaatgctgctctgccttcttcctcatcttttaaggactttggcattctattggaaacaccaagataatccatcataatttccctaaaatcatctaggataccctccttttaaggttagctgattagcaaccgtaattccatctgcaatctgcattccttttttccatgtaaaataacatattcacaagatatggcgactaggacaggaatattttggggtggggcggcattcttatcctttccacaaatggtaaacaaggtgcatttggcctctgctcttggacactgatattgcaaaggattaaatgggagggcagaaaatgaatgcaccagtggaccaataaatgaatgatccattgggaagcatctgtgcatgagaatgattgattgattggttgtttttatgagacagtgtctccctctgtgccccaggctggagtgcagtggcgggatctcggctcaccgcaacctccacctcccaggttaaagcgattctctacactcagcttcccgagaggctgggattacacccatgtcccaccacgcctggctaatttttttttggtatttttttttagtacagacaaggttttaccatgttgcccaggctatctcaaactcccaaccttaagggatccgcccgtctcagcctcccaaagtgctgagattagaggcgtgagccaaggcgccgagccgtattttaaaagaaataatagataatgctgagtgtataatttcgggtgacagagaagttctcactgatcaaataatacttgtgaccttaatgaaaaaaatagatcaacccctggaagattggcggaaggattttccacacagctgtcagccgtgaaggcacaaaggtgaaaacaatgttatgtggaaggaagaggctctgcctgaaatgctgggaatgacatggggagaatgacaagacgactgtggagagacagagagcacactgggtacacaggaaactaaggagcaacaaggagcgtgtgtttgatactcacagccattggacttacctcggggctaactgggaatccctacatgatgaatagtgactgacatgaaaataagggaggcccaggtgcataactggaatctaggagactgtggaaaaggcaattcccgcccccctggtgaaatgtggtgctgatttagacactaaatgaatgaaagatggacacaagatgtgtttgtgaggtagagtaatttgcagggagggcttgcctggtttgatttttcctaattgtttaatcttcacttcattgatttctttctgagatttatttttcctacatgtaaatcaatacttggcagaggagtgagagatacatgaggggtggtgcaaaggaagagacctattataatataacacacaaggttctgaacggtggctcacacctgtaacccaacattttgggaggctgaggaggctggatcaagtgagatcaggagttcgagatcagcctggacaacatggtgaaaccccatctctactaaatatacaaaaactagctgggggtggtggcgcgtgcctgtaataccagctattcgggaagttgaagaaggagaatggcttcaaccagggagggagaggttacagtgagccaagatcgcgtcattgcactgcaccctaggtgacagagtgagactccatggcaaaaaataaaaataaagaatacataaatataatataacatacacgaatgacaaaggcacaccaattccaatcatcatttttctatttctctataatgacttctttgatcctttatcctatccgtaagaaaatcaggcgaaaacatcttccttatttggctttctgtgagcatgagatcatatggaaaatgtgaaacccaccagcacaggtcctggaatagagaacgtgatctgttcatggcacaaaacttgccccttcacccaaatcccccacctcacccctacttccaatcacattaatgatacagatagatcatggggaggtaaaaactaatattctttggagttcagatcgtagactcagagaccagtgccagcactatctcctggtcaccttttggagtaattcacagaaagacaggctgtattgaagcaacagatgatggagggggtggtctttcccccagactctcgggtggaacagcagcctaatatctgactcccaagatgacaaaagtagcatgttgcccacgagcttcatcattatttcctggctgtttgatataagacagctcaacctcacttatgttgatttcaatgtcactgttttttccttttcttggagaatgtaatttgtttgagtcaagagggttgtggatgtagaaactgtaaagcacattcactgtgtatcaatcccagtccagtcttcccagagaagactctaaacacctcccatactgcacctggggctgtgccaatttctatcactcaccatcactccagggagacagaacacacagggaatacattacataggcaggttcattacttatagataagcagcgagtgacaacagaaaccttcctttcagggtgagccagtccctcaaggctcagaaaaactgctcaggacacatggagtcacttcatgtgcactgtagctgggggaagccagaaagcagcccagcctgggttttgtaccctggagccacagggaacactcagctaaagcactgcatgatgttctcctccaggaagaacaggaagacagcccaggctgttctgagacgttcctcctgatctcaggatgttgctgtcttagcctatttttgttgctataaaagaacacttgagcctgggtatcttctaaagaaaagagatgtgtttggctcactgatctgcacgctgtactagaagcaggacactaccatctatttctggctgcggcctcaggctgctcccacactgacagaagagaagggggtcctgcgtgtgcagagaccacagagatcacatggcaagagagggagaaagggggtgtgatggagcttccaagctctttttaagaatcaactctccagggtactaatagagggagaacttgctaaccccgtcctctggggacagcattaatctattcatgatggatccacccccatgaccaaaacacccctcccaataggcacaactcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaactgctatggttagcttcttattggattcccatcttcctccaggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaaagtctctggcccaaggcaggagccagaggcagagctttctagagagagcaccagacaccctgcccctgccttcagctcacagaccgttgcctgattgtgaactgtatcctcacgtcccctgcagccactcacatccaggagaagattccatgacaggcagaaagtgggagatagaatcaatgggatgggaactgacagctattcatggaatggggtcttgcactcagagagatggaatgtctgagtctggctgttggcagctgagggacctcaggcacctatggcctccccctgtgtgttggtatctgttcatgaaatgaggacccagaagtgccctcccagctgttttgattgcttccgtctcctacagatgctgctgtaatgaaccaagagcctgcgggacacagaacagtgaacagggaggtaggtcctcctagcccagcctcatggatacagtcttattccgaaatagtcctgaaaaatgtgaacaccctccctcactcaggatttccctctctccaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 217 - DNA, 7457 bp, Homo sapiens
  1st Promoter of KIR2DL4
acacaaactacattacaaaattacagtaattaaaacaacacagtacttgcataaaaacagacacatagaccaatggaagtgattcatagcccaggaaaaaaatgcatgcatttagggtcaaacaatttttgggatgtgtcaagaacacacaatggagaaggaacagtctctttaataaatgggattgggagactgcatgtccacatgcagaagaatggaagtggacatttgcctcacaaaacatacaaagtcaactcaagatagattaatgacttaaatgtaagatgaaagactataatcccagcaatttgggaggccaaggtgggcagatcacctaaggtcaggattccaagaccagcatggccaacatggtgaaatcccgcctctactaaaaatacaaaaacagctgggtgtggttgtgggtgcctgtaatctcagctactcgggaggttgagacaggagaatcacttgaacccaggaggtagaggttgcagtgagccgagatcgcaccactgcactccagccggggcaacacagtgagactccatcttaaaaaaaaaaaaaaaactactaaaagaaatcaagggaaaactccactggcttgggcaaaaccattttggatattaacccaaaggcccaggcaacaaaagcaaaagtagacaaataacattatatcaaattgaaagtttctgcaaagaaaaaaaaaactcaacaagtggaaagacaacctatggaatgggagaatatatttgcacccatacatctaataaggaattaatatccaaaatatataagaaactcaaacaactcaatggtaagaaatcaaataacccaacttaaaaaaatgggcaaagtatctgaataaacatttctaagaataagacaaatcaccaaaaggtatatgaaaaaatgattagcattactaaacatcagctaaataaaaattaaaactagaatgagatatcacctcacacctcttagaatgaccattaacagtctgggcatggtggctcatgcctgtaattcaggcactttgggaggccgaggcagggagattacctgaggtcagcagttcgaaaccagcctggccaatatggtgaaaccccatccctactaaaaatacaaaaattagcagagtttggtggcgcacacttgtagtcccagctactctggagactgaggcaggggaatcgcttgaacccaggaggcagaggttgcagtacaccgagattgtgccactgcactccagcctgggtgacagagcaagactgagtctcaaaaaaaaaaaaaaaaaaaagaccattatcaaaaacataaaaaataacaagggttaacgaggatgtggagaaaagggaacatttgtatgcagttgatgggaatgtaaattagcacaaccattatggaaaacagtctggaagttcctgaaaaaattaaacatagaattcccatatgtgtctgcaatccaactactgcgcatgtatccaaaggaagtggaatcagtatgttgaagagatatctgcattcccatgtttacagccgcattattcataacagccaagatgtggaatcacccttactgcccatctatgggtgcatggacaaagaaaacgtggtatacgataggaacgtaatgaagtactatacaacctttacaacaaagaaggaagtcctctcatttgtgacaatgtgaaaaaacttagaggacattatgttaagggaaacaatccaggcacagaaagacaaatgccacatgatctcatgtgtggagtgtaagaagtggaacctagaggaacagtaaaatggtcgtcgaaagaacctgggatggagagagattgaagagatgttggtcaaaggatgcaaaatttcagttagaagaaatcggttcaagagatctattgtatgtcttggtgactccagttaatagcaacatatggtgtattgaacattactaagagattagattttacatgttctcaccacacacacaaaacatacaagtatgtgaaaaaataaatatgataaagaggttgtttcatccattccacaatgtgtacctatatgaaaacatcatgatggacaccacaaatacccttttcctcattaattaaatttgttttggttttttttttgagatgcagtttcactgttgttgcccaagctgaggtgcaatggcgtgatctccgctcactgcaacctctgcctcccaggttcaagcggttctcctgactcagcctcccaagcagctgggactacagttgcgtaccaccccgtccggctatatttgtgtttctagtagagacagggtttcgccatgttggccaggctggtctcgaactccagacctcaggtgatccacccgcttcgccctcccaaagtgctagatttcaggctgagacaccacacccagcctgtacattgactttctgcccttaaactgtgctgaagtttgtttctcagatgtaggagcctttgggcagagactatggggtttctaggtatagaaattatctcatcttcaaacagaggtaatttgactacctctctctgctactctcttcttacttggatgccttataattctttctctttcctgatggctctgtctaggacttcaagtactatgttgaataggatggtgagagtgggcattcttgtcttgtttcacttatgaagggaacttcttccagcttttactcattcagtatgatgttggttgtgggtttgtcacaggcggctcttattatattgagttatgtttcttcaatgcttagcttgttgagggcttttaacatgaagaaatgcttagtaaaaagtatgttctacatgtgtgttgagaagatcatgtggtttttgtttttagttttgtttaggtgatgaatcacatgtattgattgtgtatgttcaaccaaccttgcaccctaagaataaagttgacttgatcatggtggattcactttttgatatgctgcgggattcagttcttagtattttttgtggatttttgcctctatgttcatcaggaatattggcatgtagttttcttttgtttaatgttcttttctgtctttagtatcagggtgatgccagccttatagaatgagtaaaggccaccctgggcaaacagtgagacccatccctttttaaaaattatgagttttacaaatttaaaatgcatagtgaaaaagttcttacaaactccagaaagataggtgtaaataagagacatttgtaagaatgacagcacattaaatgtgtagatttcaaccttcagttattgcaatattccagtatcaagttggaggatgttatcagtctgatattttttcctcaaatgagagagagaaagaaagacacacaaacaacacagggagaaaaaaagcacacgttacagagagacaaaaagggagacagggaactgtgaatttggactcttgtgtcataagacaaattctagataacacgaccagaccttcaattgacatattgtgtttttgctaataaggtggaattctatgatgcgaaataactatatagtcttttctactgggatttaaatcattttatctgtttctggcttaacaggaaaaatacaaccatggaaaattatgatgatttatttaatacgattgctctatagtgttaataaaacctattaggtattttgcatattacatatcaaggagagtttgaatctcaggtagaaacaaaaaaaaatacatcaaatttcctcatgtgagtgcagaattcaatcgtcccgtgcaggggtaagtgagtctgagatgtgttttgagcctggccgttgcgcatgatgtgaagtgacaagtctagtctgcagttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttggtgagtcctggaagggaaggagcaccagggttacactatgggcctgcagattgggtgtctccccagcagagagccatgttctgaagcaagtgagtggtgaggatgagttaattttcagtccagcgtggcgcccagtggctcaggaggaaagggtaggttgctgccgagatgaatagttcatcatgatctttctttgcagggttcttcttggaccagagtgtgtgggcacacgtgggtgagtccttccccaaatgatgggttgccatcttcaccccaatacaagtgaattttccagaaatgggagggaggcagcacagagggtgggctgatgggctgaccatgggaaggcctggggggagtctctcatgaactagtaagaggagatcctgggagtctctcatgaactagtaagaggagatcctgggagtctctcatgaactagtaagaggagatcctggtatgctcagccctctgttttgtcttagccctccccagcctttcttccccatggctgagttgagctctgtgtggcccaggcgggatactgaggtgctcaaagctggggtgtgtggggggatgtggtgtcaccgacagaggagggaagggtagcagtgttaggaacagcaggtcctctgaggacaagagggtaactcacaccctccagcgtttccatgacggtaggggctgcagtgtggctgctgtcattctgccagaagaggtgggggaaccacagccacgaccctgccattccaaatcctctgatggagctcagttgtttattgtggttcaggcattagctaatattccattcacaaaggtcataccctccaccccatgtctactttgtgttctttggtgtaactaatcttgcagtattaaaatctagtaagagtcccttactcagcacctgctcagttctcaactgacacttttgttgtagggagacgccacgtctatgcgggatgggtccttcctgtagccccaggcacccaggtgtggtaggagccttagaaagaagaaatggggagaatcttctgagcacagggagggaggggcagctcaacatactcctctctgaggcggcatctccttctccccaaggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtcagagggctcctgtctgggcttctccttgtcccacctcctgagtcccagagcttctggtgggggtgtccaccagagtccgatcatccaggccccaactatatttggggtaaagggggattgaatacaggggaatgggtgctgtgttggaaagaataactgtccccatcgatggccacattgtaatccttggagcctgtgactatgttatagggcaggggactgaaggggaagatggagctcaggttgttgatgagttgaccttgagatggggagatggcctggactctcccactgggctcagtgtaatcacaagggtccatatgagtggagaaggaagaggagaatggggattagagcagcatcgtgggatactccaccagccactgtgggctttgaaggtggaggaagaccacgagccacgaaggggctggagaaatcaatggaactgattctcccgagtctccagagggaatgcagccctgcagatgccttgattgtagcccaggaagaacagggtctgatttctgtctccagaagtggaaggggtcagtgtgttctctcctgccgccatgtttgtgataattttctccagcaacaacaggaaaccaacacaggaacccaggtgaaggacaagttaaaaaaccaaacaagaaggttggctaccctgagatcagcaagggtgcactgctgatgccaccaccaggctggaaccacatagggagggatcgacaggaagagttgggggtggagggtgagagagagagagagagcactaggccatagagcagggcagtgagttctcagctcaggtgggaggggagctgtgacaaggaagaacctccctgaggaaactgcctcttctccttccaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggtgaggaaagccaatgtctgtcccatgtcctatggtcctagagccttagctgaggagcttcctgctgatgatggagagaagcatggacagatgtggagagaagatgcagcatggtgtgagggtgggatcagggcacaggatggcagacagggcacctccaaaccctcctgcatggcctgcatggaagcttgcagtaagggctccgggtacccaggcagatggagaaagtggtcaggacagacccagaggagggagactgggctcagtttggggagatcagaggttccctcagcccctcaaccttacccatttcccagaagcccaccctggcctctcacctacacagagatgtcatcaccagcaacccctacactttttcttttcctttgaaaaaatgctgattgaggttaaatatacctatataatttatcaactttaccatttttaagtgtaaaatctagggatcataaatacctttatatgctgtgtgcggtggctcatgcctgtaatctcagcattttgagacgccaaggcaggtggatcatttaaaatcaggggctggagaccagcctggccaacatgggggaaccaatctttactaaaaagacaaaaaaaataaaattagccaggcatggtgccaggcgcctataatcccagcaacttgggaggctgaggcgggagagtggcttaaacccaggaggaggaggttgcagtgagctgagatcatgccactgcactgcagcctggtgacacagagagactctgtctctaaataaataaataaatacttttatattcttcttttgttaccctccaccccttccttcctaacctctggt

SEQ ID NO: 218 - DNA, 832 bp, Homo sapiens
  1st Enhancer of KIR2DL4
gtattttgcatattacatatcaaggagagtttgaatctcaggtagaaacaaaaaaaaatacatcaaatttcctcatgtgagtgcagaattcaatcgtcccgtgcaggggtaagtgagtctgagatgtgttttgagcctggccgttgcgcatgatgtgaagtgacaagtctagtctgcagttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttggtgagtcctggaagggaaggagcaccagggttacactatgggcctgcagattgggtgtctccccagcagagagccatgttctgaagcaagtgagtggtgaggatgagttaattttcagtccagcgtggcgcccagtggctcaggaggaaagggtaggttgctgccgagatgaatagttcatcatgatctttctttgcagggttcttcttggaccagagtgtgtgggcacacgtgggtgagtccttccccaaatgatgggttgccatcttcaccccaatacaagtgaattttccagaaatgggagggaggcagcacagagggtgggctgatgggctgaccatgggaaggcctggggggagtctctcatgaactagtaagaggagatcctgggagtctctcatgaactagtaagaggagatcctg

SEQ ID NO: 219 - DNA, 7120 bp, Homo sapiens
  2nd Enhancer of KIR2DL4
atccacccccatgaccaaaacacccctcccaataggcacaactcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaactgctatggttagcttcttattggattcccatcttcctccaggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaaagtctctggcccaaggcaggagccagaggcagagctttctagagagagcaccagacaccctgcccctgccttcagctcacagaccgttgcctgattgtgaactgtatcctcacgtcccctgcagccactcacatccaggagaagattccatgacaggcagaaagtgggagatagaatcaatgggatgggaactgacagctattcatggaatggggtcttgcactcagagagatggaatgtctgagtctggctgttggcagctgagggacctcaggcacctatggcctccccctgtgtgttggtatctgttcatgaaatgaggacccagaagtgccctcccagctgttttgattgcttccgtctcctacagatgctgctgtaatgaaccaagagcctgcgggacacagaacagtgaacagggaggtaggtcctcctagcccagcctcatggatacagtcttattccgaaatagtcctgaaaaatgtgaacaccctccctcactcaggatttccctctctccaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattctttaggtgactctttttttggctgaaagtttccagtgttatcattaccatgtccaaataactccaactgttctccactgggttctcacccctggacttggagcttctggaagcagggtggagcctgatttgtctctgagactccaatttccatccaaagatgcagcacataagaggttccaaggatcgtgaatcacatgaacaagtgatattcttactctctgcagacctggaaagctggcagagtcattccatgatgaaacatttgtagagtcataggccttgttagtctcatctccacggggacacatatcaacacatcatctttcatactataaatatacagtcggtcctctgtatctgtgggatttacaggtgtttattgaaccaaatataaatcaaaaatattcagagaaaaaatccacaaagtttcaaaaagcaaaactatgttgaatggacacaaatgaagctgtgtgtaggctgtatcaggaattataaataatcaagggatgatttcatgtacacaggaggatgtgcatgggttatttgcaaatgctgtgccatttcatgtaagaggcttgagcgtctgcagattgtgctatctgagtggagatcctgaaaccaatcacccacgaatagtgagggatgactgtatataatttttatttctcaattttaaatataaaacataaaaaaattacaataacaagataaaataaacaagtgttttatagtgtgagaatacgtttagatatatttttctctatgtgtaacccttgggcccatgttatttattgagaagacattctattccaccttaaaccacatggcagcctttgtcaactataaagggactgtgtgtacacggatgtattttagacactgttttctgctcagtggctctctctctgtccactctcttgagaatgctgcattttatgcagccttatacaacccctaaaatttggtagctggagtcctctagttatttattataggctatttgctatgctttttttatttttcttgaggcagagtctcgctctgttgcccaggctggagtgcagtggcacgatctcggctcactgcaacttccgcctcccaggttcaagggattccgtgcctcagcctcttgaatagctggcattacaagtgcctgctaccaggcatggctaatttttgtatttttagcagagacatggtttcactatattggccaggctggtctcaaactcctgacctcggttgatcactcacctcggcttccaaagtgctggggaaattgattttctatagcattatgttactggatatttctgtaaaatttaaaatgagggaggcagagagacagagagagagcaaaccatgagttggaactctggaatcttgggacatgagacaaattctagataaatctacaaaaatccagaatttacatgttgtgatttttgctgataaagtacaattctaagattgtaaataattgcataatccttccctgggagtttaaatcatttgaactggttctgctgtaatactagaaatacaatcatgaaaaattctaatggtttattgtcacaattgctctgaaaaccttaataatacctattagatattttgcatattacacaggaagaagagtttgaatctcagataaaaacaataaaaatacatgaaaagtctttcatgttagcacagattttaggcatctcgtgttcgggaggttggatctgagacgtgttttgagttggtcatagtgaaggacgcgaggtgtcaattctagtgagagcaatttccaggaagccatgttccgctcttgagcgagcacccactgggcctcatgcaaggtagaaagagcctgcgtacgtcaccctcccatgatgtggtcaacatgtaaactgcatgggcagggcgccaaataacatcctgtgcgctgctgagctgagctggggcgcagccgcctgtctgcaccggcagcaccatgtcgctcatggtcgtcagcatggcgtgtgttggtgagtcctggaagggaatcgagggagggagtgcggggatggagatctggacctggaggtaaagatatgggcctagaggtggagttatgggcctagaggtggagttatgggcctgaagtggagatctgggcctggagtggagatctgggcctggagtggagataggggcctggggtggagatatgtgcctggagtggagatctgggcctggagtggagatatgggcctggggtggagatatgtgcctggggtggagagatgggcctggaggggagatatgggcctggaggggagatgtgggcctagaggtggagtgatgggcctagaagtggagcgatgggcctggagtggagatatgggcctggaggtggagttatgggcctgcagtagagatatgggcctgaagtggagatatgggcctggagtggagatatgggcctagaggtggagttatgggcccggaggtggagttaagggcatgaagtggagatctgggcctggagtggagatatgatcctggagtggagatatgggcctggggtggagatacgggcctggagcagacatacaagcctggaaaggagatatgggcctggagaggagatagaagcctggagtggaaatatgggcctggagtggagatatgagcctggagtggatatatgagcctggagttgagataggagcctggagtggagatatgggcctggagtggacttaccagcctggagaggagatatgggcctggagtggagatacggacctggagtggagatctgggcctgttgtgtagatctaggcctggaggtagagatctgggcctggaggctcagtctctgcacagccgagatccttgttcctgggggcaggtaggcagcgagggtgagtttaccttcagcccagcaagggcctggctgccaagacgcacagcccagtgggggcagcagggtgccctggtttgcctgcagagggatggtccatcatgatctttctttctagggttgttcttggtccagagggccggtccacacatgggtgagtccttccccaaaccttagggtgtcatctccccacataagaggattttcctgaaatgggagggaagtcctgtcggggagtctctcatacactaggaagaggggaccctcggatgctcggcccacatttctgaccttgccttccccggcctttcattccctttcctgagtcaagctctgtgaagactggggtgagactagggtgctccaagatgggtgtgcagggaggaagtggtgtcagcagcagagaaagagagggaagcagtgctaggaacagcaggtcctctgaggacaaaggtgtaactcacaccctccagcgtttccgtgatggtaggggctgcagtgtggctgcggtctttctaccagaaaaggtgaggaaaccacagccatggccctgacattccaaatcctctgatgggggctcagttcatcaattggctgatattccattcacataggacttgccctccatgccgtgtctactttgtgttgttttatatgagtaattttgcagtattaaaatctagtaagagttgcttctccagcaacttgctcaaagttctcagctgacacttgttgtagggagacgccaagtctatgcaggatgggtccttcctgtagccctgggcacccaggtgtggtaggagccttagaaagtggaaatggggagaatcttctgggcactgggagtgaggggcggctccacatcctcctctctaaggcagtgcctccttctcccccaggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggtcagaggctttccgtctgggcttctcactgtcccacctcctgaatcccagagcttctggtgggggtgtccgtcagggtcccatcacccaggccctgactgtatttggggtcaagggagattgaatacaggggaaatgggtgctgtggtgggaagaatcactgtccccaatgatggctacattgtaatccctggagcctgtgactatttatgttacagggcaggggactgaaggggaaggtggagctcaggttgttgatgagttgaccttgagatggggagacagcctggactgtcccactgggctcagtgtaatcacaagggtccacatgagaggtggaggaagaggggagtggggattagagcagtgtagtgggagggagacgctatcagccactgcgggctttgaaggtggaggaagaccactagtcacagaatgcaggtggcctctaagggctggagaagtcaagagaactgattcgctgattctccagagggaacgcagccctgtagacaccttgatttcagcacagggagaactggatccaatttctgtctccagaagtggaaggggtcagtgtgttctctcccgctgccatgtttgtggtaattttctgcagcagcaacaggaaaccaacacaggaacccaggtcaaggacaagttaggaaaccaaacaaggatagccagatgtggtggtgggcacgagtaatccaacgactggggaggctgaggcaagagaatcacttgaactggggatttgttcaaaagagattgattcaggctgctaagagcctggacatgcagcctgtcctcttccacccccacatagacagcaggaaagagattagtgggaaacagatacaacagcccaagagatgaggctgtcttcacagtggcaagggagtcaggggctactggagacagagggacagagaagagggaggaagacagatggaggcacctgcaccaggggatatgggcacagaaaagacacggagatgcagagagggaggagagagacagacacggggaggggaaccctcactcattccaggtgccatggatgggatgataaagagagatgccttctaaactcacaacttctctttctaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgc

SEQ ID NO: 220 - DNA, 1580 bp, Homo sapiens
  cDNA KIR2DL4-001
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 221 - DNA, 1447 bp, Homo sapiens
  cDNA KIR2DL4-003
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 222 - DNA, 1656 bp, Homo sapiens
  cDNA KIR2DL4-201
atgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 223 - DNA, 1601 bp, Homo sapiens
  cDNA KIR2DL4-008
catgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 224 - DNA, 1396 bp, Homo sapiens
  cDNA KIR2DL4-004
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 225 - DNA, 1026 bp, Homo sapiens
  cDNA KIR2DL4-006
atgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccac

SEQ ID NO: 226 - DNA, 715 bp, Homo sapiens
  cDNA KIR2DL4-007
gaagctgcaccatgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtc

SEQ ID NO: 227 - DNA, 1500 bp, Homo sapiens
  cDNA KIR2DL4-005
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 228 - DNA, 1342 bp, Homo sapiens
  cDNA KIR2DL4-002
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 229 - DNA, 8586 bp, Homo sapiens
  2nd Promoter of KIR2DL4
tggaatgagtgaatgaatgaatgaatgaatgtatgaattagtgagtgaatccttagcacttggtgaaagtgccatgcacagaatgaaatgaatgaacgtggaacgttgtcatttggagtgtacaggagggaacgtctcactgagacctcatcagagagatcacatttaaactccgatcttagagacaagagggagtgagccctggggagtgtgttgaaaggaactttcatggacttaggacattggggatgaccctaatgtgagaatgagcttggtgtgttccaagaagtccatggacctgccatatggtgagggctggtcagaatccagagagatttctaaatgcccttgtgcttgtaaggaaagtgagtcctgtggttgggagtggacttataccttgggtcaggtccagcaattatctttctaaatcctctctaattgcctgaaccacttctatcaacaactgagaaaagaggagtgttaaacaccccactgtggccgtggatttgcctacctgtccatttatttccgcgactcttcctccatgtatatttgcaggaatattactgggagtggttaagtgtaaactgattatatattcctggtaaatttaaaatgctataaatttacctgcttttttcctacattttatgcttaatgttttccgctgatttttcccaaagactaattttgtctaattttaatatagttataccacatttctaacagtgattgcttggtatatttctacattgtttaatttcaaactccatgaattgttaacattgagatgtgtcctttgtaaatttcaaacaattcgccttagaaagtaagactttctgacaatcttttgttcatgtttgagcagttcttccaatcatatttttgttattattacgttgtgttttcctgattccctttttttcccactgacttctgtggttttctatttcaaacattctatttttgatctatgtcgtttaggaatacatatatggtgtactcatcctgaagttgttacatatttttaaaattgaaattaatcatttcagagattaaactgcaaatataaaaacatatttccactcttcctgtgtaagaacaggattttagagcatatttagtacatatgtttgtatttacttatatgatgttttgttttgtggtatacataattctatctttttcagaaattacacaggggcgtgttttcatacactatcgtatggtccatattcatttttggcatagccatatttttagttcttcctctgctcttagttattgtcagaatcttcgacaccccatctggtttcactttctttatctttgaggcacggtcatcagaatttcctttagggtcagtgagaaaagctttctttgcccttttgtctttcagttctgtttctttcctgcgttgatcttggacagtaactgtactatgtaaggaattgtcggtggctggcgacggtatcttagctgggtaaagatgctattctactggcttatgttttccttttttctgtggggaagacaatgcttggctccctataaatccttaccagctgatccttttcctctggctaattttaagggttggttgtgcttttatgctgcttttctgtaatgttgaacgtgaggtgtgtttacttcattctgcctggcattcactggatttcttgaacctgtggattgatggatgtgtctacttcctccaaataatcaacaattgcctctttaaagattgcttctgacctgttttctcgttctttctttttggaactcaagttaggagcattctaaaactgttgtcaatttttaccctgtcacaaaactgctctttcttgtttcagttatttgctttttctgtgcattaatattgatggtttcctctgtcatagaggataaatactctcttcactgttgtgtacacaacattttaactagttattctggtttaaatttaatattgactttatctacatatcacaattgattactgtgtacagactttcttttctattagtataaatttatgaggtacacttgtaattttgtgacatgagtatgttgcagagtagtgaagtcaggacttttactatatccatcacccaaataccgtacattgtactcattaagcaaattctcatcactcacccacgtcccgccaccctccagccttctagcctccgctgtccgtcattccacactctacgtccatatgtacacattactcccctcccatgtagagtgagaagatgtggtatttgtctttctgagtggttttatgtaaaataatggcgtccagctccatctatgttgctgcaaaagacatggttttatttttatgaccaaatagtatttcgttgtgtatacacgcatcctttttttaatccaatcattcattcacagacacttagattgatttcatatctttgctattgcaaacagtgctgcaataaacatacaggtgcaggtattttttgagtagatacccagcagcgggacccctagatcgaatggtgcttctatttttggttctctgccaaatttccatactgtcttccatagaggctatactaatttacataccggccaacagtgtataagagtttccttttctctgcatccttgccaacacctgttatatgtttcactttttctttttttctttttgagatggagtcttccactgtcacccaggctggagtgcagtgccgccatctccacgcgctgcaacctccaccaaccaggttcaaatgattctcctgcctcagcctcctgagtagctgggattacagaaccacaccaccatgcccagctaatcttttgtatatttagtagagatggggtttcactatgttggtcaggctggtctcaaactcctgacctcatgatccacccgcctcagcttcccaaagtgctgggattacaagcgtgagccaccactccccaccagcatttttagtaatagccattctgactactgtaagatgatatctcattgtggtttcaatttgcatttctctgatgattagtgatgttcatacgctgtttggccattcgtatgtcttcttttgaaaaatgtctatgtatatccctttgcccactttttaatgctattatttgaggggttatgtttagttgtttgagttgcctagaaattctggatgttagtcctctgttgggtgcatagtttgcaaacatttccattcattctgtgggttgtctgttcaccctgctactatttcctttgcttggcagaagctctttcgtttattaagtcccattggtctagttttatttttattgcctgtgcttttgaggtcttagtgatgaattctttgcccagaccaatgcccagaagagtttctctttgggtttccaccggtgattttatagttctggatttacatttaagctgctaattaccttaagttaatttatgtgtatgattacagatacaggtccagttttattcttctgcatatggctatttagttttcccagcaccttttattgaaaaggaaatctttctccagtgtatgttttgttaacgtcgtcaatgattattcactgtagatatgaggctgtatttctgggctctctattctggtctattgatctctgtttctgtgtctataccagcactgtgctatttaagttactatagccttagagcatagtttgaagtcagatagcgtgatgcctccaggtttctacattcacctagaattgctttctctattaggatcttttttggttctgtatgaattttaggattgctttttctaattctgtgaaaactggtgttactattttcatataagaattgcactgaatctgtagattgctttaggcagtatggtcattttaacaatattaattcttatgatccatgagcgtgggattttttttctttttttttttttgtattatctataattgctttcattggtgtcttacacctttcctggtacagatctttcaccaccttggttaaatgtattcctgagtgttttaattttgcgtatctattgtaaacggcattgccttcttgatttggttctcagctagatcattataggtgtagagaaatgctaccggcttttacatattgattttgtattctgaaactttacttagttcatttatcaatcataagaatttttggcagggtctttaggattttctagatttaagatcatagcatcagaaataaaaataattttacttcctcttttctaatttggatttttaattcttcctgttgcccaatagctctgacaaggcttccagtactatgttgataggaagtggtggatgtccgtgtccttgtcttgtgccagttctcagaggagtgcttttaacttttcctgttcagtatgatgttgactctagatatgtcatctatggcttttattattttgaggtatgttctttctatgcctaagtttttgagggttttcatcaggtaaggatgttgaatttcttttcagatgcttttctttatgtctattgagatgatcatatggtttttgttctggattctgctcgttcttctaagtggatgagacatgccagaaaagcatttagtcagccatcttggaaacaagcatctcagatgttttctttctctatagctcattctttcttaccagtgttttcaattttgtacttaattttgtaaagagagtaaatgatataatttccacatatgtttcctctgccaaatcagactcactatgcttcctttccttgtatacataacctacccagcaatacacacaaacatttattgctttggagaattagtttgggaacatttttgaaatgtacaaaaaaatgtatatcttcaaaagaaatttctttttgtggcaaaagacttctgaaggtgctcatgatgatatagggagaagaggggttctggacaggaagaattttatgaaggtgagatggggaaatagctccatttcagagcttctggggagagaggggcctggcccacatggaaaggtctctgatcttacccccaccctccagcccctgttctccagaactatactgtggagagttccatcaggattgttgtggctggtctggtcttcctggctcttttggcaatgctggctaagacctggtggagacatgaggggccacaggtggaaatggaagaaacatgactgaagctggctggagtgaatggcgcgacattctgtctgtgggagattggccagatgggtttcaagtgtgttgtatcagctgtgacttttagtaatgttcttgctaccacaatatccactcgtccatcccgaataattgtgatgaaatattgtccttgggataatattcatttgctaaagacagggatgatacctcaaggtgccactatatacatcgaggggatccacaaaagtccattcagtaaaatgtagttggcatcttagggtaggttgattccacctctaaaaaagtaggtacaacatcaggttgatttttccgaagaaaagtggtgattggccatctttagtctcaatgtaaacggtaatactgatgagtgtggaaaaggcagggaagaggattgacaataagtgacactcattgttttcatctgagctttgagactgaaagaggaacacaggagtgagatgtatgggaacaaaccccttctttttccagctaaacagagtggaagttggacactgagttttggcgtacagcaaaatcctaagtccattgttgggttgaacacggccatgttgtacatcctggtttcacagcagacactggaggaaaacagcctgtattcataagaggctgtccctcgggtcactgcccagaatatccggagttggtgctcacagggttgggaactctcctggaccagacaggctctggatatgggggggtaccaagctccccggggccatgcctccacagctctcttctcacctcattcttgaccatttcccaaacctctgacctcaccttcattcatccatggtgaacacgctaaaactggccttcaaagcttgagacagaggaaaattgggcttcatctctgggaactaaattggggagtggagactcagttctggcctgacaggagggagaagaccctggatcccagtgtggatgggaagaagtatgtgtttctcttttgtgcttggaccctgtgtccaagcatgtctgagatgtgatgaagatgaatcttcctttccttgtctattttctcatgccagagaattggaatcttatattccattaactctttctgttctgttcatccagattctatgaaggagaaaggaaaagatgtgatactgtaattttgctccatttgtctaaaatgagtaggctgcaactcctcttgaagtgataccttttctagctcttgttggaggtgtctcaggactcattacttcggggaacctgcaactgtgtcagtctggggaaactgcaaatattcttgtcttacatttgtctccagccaattgtgatggactccagtgacctgcaattgctgttattgcaggtaaaatgtacctgagtcaggccacagttctcctggactatgagcccctggccatgttcctgaggcaattctgttcatctaaatataataataataacacactaaaaatggcaagccattgttaattcctgaagtctcatttgaaaattactaaatgtctgttattttttggtgtttacattatatgtagacagataaactacacacacacacacacacacacatgcacacagaagaatggattgtttcatgtagaaaagtaaataattcaagatgaaaggatgaaatgtcatggcacctactattctattttagataaagggtctatgaaaagattgatttctttttatgttttatttgttgacatttgaacacaaactatgtaagtgagggagtcgatttgaaagggagaagagcaagttcaaacacattcaggtgaggtcatgctttacatgttttaattgaaatgatccatcttgggagtagatcaataactgagatggtgccaggaatgttaaaaagcttttgtcagtcctaaatattgacaaataaaatttaattaaagtcttagaagaaaacacaaaggaaaacttcacaacatcggatttggcagtgattctttagatgtgacaacaacggcacaggctactacagaaaaaataaacaagttagactttatgaaaattttgaaatattgtgactcaaaagacaacatcagttacttcacatggcaaggaaaaagaacttttaagacgatattatcaaagtaaaaagacaacccacagaatgggagaaaatgttttcaaaccacaccacctgtaagggattaacatccagaatatacagacaactcctaaaactcaatcacaataaactcaattcaaaaatgggcaaagtactgaaacagacatttctccaaagaacatacgcatgaaaagatattcagcatcacgaatcattagggaaatactaactaaaactacaccagatgccatttcataccccttaggatgggtatcatcaaaacaacaacaacaacaacaacaaagtttctatacattaacaacaaactatccaaaaaagtttacaagaaaataagcccatttgcaataactacagaaaacaaaacatgcaggaataaattcacccaaggagtagaaagatctgtatgcaaaagctataaaacattgatgaaaaaactcaagaaataaacaaataaatcgaaagatattccatgttcacggatcagaaggattaatgttgttaaaatgtccattctatccaaagtgattcaatgcaaccattatcaaaaatccaatgacattttttttacagaaatagaaaaaacagtcctaaaattcatgtggaaccacaaaagatctcaaataaccaaagccatctagagggaaaggaacaaagttggaagcatcacattacctaaacacaaactacattacaaaattacagtaattaaaacaacacagtacttgcataaaaacagacacatagaccaatggaagtgattcatagcccaggaaaaaaatgcatgcatttagggtcaaacaatttttgggatgtgtcaagaacacacaatggagaaggaacagtctctttaataaatgggattgggagactgcatgtccacatgcagaagaatggaagtggacatttgcctcacaaaacatacaaagtcaactcaagatagattaatgacttaaatgtaagatgaaagactataatcccagcaatttgggaggccaaggtgggcagatcacctaaggtcaggattccaagaccagcatggccaacatggtgaaatcccgcctctactaaaaatacaaaaacagctgggtgtggttgtgggtgcctgtaatctcagctactcgggaggttgagacaggagaatcacttgaacccaggaggtagaggttgcagtgagccgagatcgcaccactgcactccagccggggcaacacagtgagactccatcttaaaaaaaaaaaaaaaactactaaaagaaatcaagggaaaactccactggcttgggcaaa

SEQ ID NO: 230 - DNA, 22913 bp, Homo sapiens
  1st Promoter of KIR3DL1
gtgcagaagctgcttgatttgatataatcccaatggtctatttttttgttgttgttgtgattacttgtgtttttgaggttttaaacaaaatgtcttccctcagacaaatgtcctggagcatttctccagtgtttccttttagacatttaatggattcaggtcttaagtcattaatccattttcatctgatttttgtgtatggtgagaggtagaggtgcagtttcatccctctgcatgtagatatccagttttccctgcaccatttattgaaatgactgtcctttccagattgtagattcttcgaacctttgtcaaagtccattggatgtaaatgggtggattacatccgtgttcttcattctgctccattgttttatgtgcttttctttatgccaatgtcatgttgttttgcttactacagctctgtaacatatttttaagtcaggtagtgtgatgctcctgttttctccttataccttgaagtctcaagatagttggtgtcacctacaatgattatggagaatgggatgccaggactcccagggcccaacattagataatagaatgttggccatgaaccaacctcaaagatttccattgagtagaagacaggcatcctcattgccacacctctctcctgtcccgtgttctaggaaacccttctagtagttggccttcacccactgaaccaagcttcaaaactggtaagtgaaggacccctcttatctctgcttttggaaacctggggaggtagaagccttggattcaagcgttggctcagcacctgccagctctgtgattgtgggcctgtcttccattgtctctgaaccccagacactccaacagcgaaagggatctgggcccagcacagggctcagtgaaatctcttaatctctaattttctgctgctgagacctcagggtagaaggatgagtgcaaatcagacattcttctcaggaaaaatgctgtgtttgttctgcctgcattcctaactgggaggacaaatgcctgggggcttgagaaggggaaggaaggggaacatttttgagggtggtgtatttgtagagaagttctacttgccaaggaatgagctcctgtctgtcatgatccaaccctggttgacttagtggaacaagagctttgcggtaagagagaacgtagttcatccgtgcacatgacacttccacttactcgttcagccactgccccatgctcagactgtgcagtgtggaaccttttcctatgttgccataacaaatttccacaagcttcgtggatggaaaccacatttttaaaaaatatctcatggtgctgtagctcagaagtatgaaatgcatcatctcactgggctaaaatcaaggtgacagcaaggctgccttccctctgaatgttccaggcaagaatctgcttcctcacttttcccagctcctagaggctcccacattccttggctcctggtccccgtcttcctccctcaaagtccacaaaggctggtcacgcctctcacacggcatcactcagacccttcttccttgtccacacctctttctctgaatgctgctctgccttcttcctcatcttttaaggactttggcattctattggaaacaccaagataatccatcataatttccctaaaatcatctaggataccctccttttaaggttagctgattagcaaccgtaattccatctgcaatctgcattccttttttccatgtaaaataacatattcacaagatatggcgactaggacaggaatattttggggtggggcggcattcttatcctttccacaaatggtaaacaaggtgcatttggcctctgctcttggacactgatattgcaaaggattaaatgggagggcagaaaatgaatgcaccagtggaccaataaatgaatgatccattgggaagcatctgtgcatgagaatgattgattgattggttgtttttatgagacagtgtctccctctgtgccccaggctggagtgcagtggcgggatctcggctcaccgcaacctccacctcccaggttaaagcgattctctacactcagcttcccgagaggctgggattacacccatgtcccaccacgcctggctaatttttttttggtatttttttttagtacagacaaggttttaccatgttgcccaggctatctcaaactcccaaccttaagggatccgcccgtctcagcctcccaaagtgctgagattagaggcgtgagccaaggcgccgagccgtattttaaaagaaataatagataatgctgagtgtataatttcgggtgacagagaagttctcactgatcaaataatacttgtgaccttaatgaaaaaaatagatcaacccctggaagattggcggaaggattttccacacagctgtcagccgtgaaggcacaaaggtgaaaacaatgttatgtggaaggaagaggctctgcctgaaatgctgggaatgacatggggagaatgacaagacgactgtggagagacagagagcacactgggtacacaggaaactaaggagcaacaaggagcgtgtgtttgatactcacagccattggacttacctcggggctaactgggaatccctacatgatgaatagtgactgacatgaaaataagggaggcccaggtgcataactggaatctaggagactgtggaaaaggcaattcccgcccccctggtgaaatgtggtgctgatttagacactaaatgaatgaaagatggacacaagatgtgtttgtgaggtagagtaatttgcagggagggcttgcctggtttgatttttcctaattgtttaatcttcacttcattgatttctttctgagatttatttttcctacatgtaaatcaatacttggcagaggagtgagagatacatgaggggtggtgcaaaggaagagacctattataatataacacacaaggttctgaacggtggctcacacctgtaacccaacattttgggaggctgaggaggctggatcaagtgagatcaggagttcgagatcagcctggacaacatggtgaaaccccatctctactaaatatacaaaaactagctgggggtggtggcgcgtgcctgtaataccagctattcgggaagttgaagaaggagaatggcttcaaccagggagggagaggttacagtgagccaagatcgcgtcattgcactgcaccctaggtgacagagtgagactccatggcaaaaaataaaaataaagaatacataaatataatataacatacacgaatgacaaaggcacaccaattccaatcatcatttttctatttctctataatgacttctttgatcctttatcctatccgtaagaaaatcaggcgaaaacatcttccttatttggctttctgtgagcatgagatcatatggaaaatgtgaaacccaccagcacaggtcctggaatagagaacgtgatctgttcatggcacaaaacttgccccttcacccaaatcccccacctcacccctacttccaatcacattaatgatacagatagatcatggggaggtaaaaactaatattctttggagttcagatcgtagactcagagaccagtgccagcactatctcctggtcaccttttggagtaattcacagaaagacaggctgtattgaagcaacagatgatggagggggtggtctttcccccagactctcgggtggaacagcagcctaatatctgactcccaagatgacaaaagtagcatgttgcccacgagcttcatcattatttcctggctgtttgatataagacagctcaacctcacttatgttgatttcaatgtcactgttttttccttttcttggagaatgtaatttgtttgagtcaagagggttgtggatgtagaaactgtaaagcacattcactgtgtatcaatcccagtccagtcttcccagagaagactctaaacacctcccatactgcacctggggctgtgccaatttctatcactcaccatcactccagggagacagaacacacagggaatacattacataggcaggttcattacttatagataagcagcgagtgacaacagaaaccttcctttcagggtgagccagtccctcaaggctcagaaaaactgctcaggacacatggagtcacttcatgtgcactgtagctgggggaagccagaaagcagcccagcctgggttttgtaccctggagccacagggaacactcagctaaagcactgcatgatgttctcctccaggaagaacaggaagacagcccaggctgttctgagacgttcctcctgatctcaggatgttgctgtcttagcctatttttgttgctataaaagaacacttgagcctgggtatcttctaaagaaaagagatgtgtttggctcactgatctgcacgctgtactagaagcaggacactaccatctatttctggctgcggcctcaggctgctcccacactgacagaagagaagggggtcctgcgtgtgcagagaccacagagatcacatggcaagagagggagaaagggggtgtgatggagcttccaagctctttttaagaatcaactctccagggtactaatagagggagaacttgctaaccccgtcctctggggacagcattaatctattcatgatggatccacccccatgaccaaaacacccctcccaataggcacaactcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaactgctatggttagcttcttattggattcccatcttcctccaggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaaagtctctggcccaaggcaggagccagaggcagagctttctagagagagcaccagacaccctgcccctgccttcagctcacagaccgttgcctgattgtgaactgtatcctcacgtcccctgcagccactcacatccaggagaagattccatgacaggcagaaagtgggagatagaatcaatgggatgggaactgacagctattcatggaatggggtcttgcactcagagagatggaatgtctgagtctggctgttggcagctgagggacctcaggcacctatggcctccccctgtgtgttggtatctgttcatgaaatgaggacccagaagtgccctcccagctgttttgattgcttccgtctcctacagatgctgctgtaatgaaccaagagcctgcgggacacagaacagtgaacagggaggtaggtcctcctagcccagcctcatggatacagtcttattccgaaatagtcctgaaaaatgtgaacaccctccctcactcaggatttccctctctccaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattctttaggtgactctttttttggctgaaagtttccagtgttatcattaccatgtccaaataactccaactgttctccactgggttctcacccctggacttggagcttctggaagcagggtggagcctgatttgtctctgagactccaatttccatccaaagatgcagcacataagaggttccaaggatcgtgaatcacatgaacaagtgatattcttactctctgcagacctggaaagctggcagagtcattccatgatgaaacatttgtagagtcataggccttgttagtctcatctccacggggacacatatcaacacatcatctttcatactataaatatacagtcggtcctctgtatctgtgggatttacaggtgtttattgaaccaaatataaatcaaaaatattcagagaaaaaatccacaaagtttcaaaaagcaaaactatgttgaatggacacaaatgaagctgtgtgtaggctgtatcaggaattataaataatcaagggatgatttcatgtacacaggaggatgtgcatgggttatttgcaaatgctgtgccatttcatgtaagaggcttgagcgtctgcagattgtgctatctgagtggagatcctgaaaccaatcacccacgaatagtgagggatgactgtatataatttttatttctcaattttaaatataaaacataaaaaaattacaataacaagataaaataaacaagtgttttatagtgtgagaatacgtttagatatatttttctctatgtgtaacccttgggcccatgttatttattgagaagacattctattccaccttaaaccacatggcagcctttgtcaactataaagggactgtgtgtacacggatgtattttagacactgttttctgctcagtggctctctctctgtccactctcttgagaatgctgcattttatgcagccttatacaacccctaaaatttggtagctggagtcctctagttatttattataggctatttgctatgctttttttatttttcttgaggcagagtctcgctctgttgcccaggctggagtgcagtggcacgatctcggctcactgcaacttccgcctcccaggttcaagggattccgtgcctcagcctcttgaatagctggcattacaagtgcctgctaccaggcatggctaatttttgtatttttagcagagacatggtttcactatattggccaggctggtctcaaactcctgacctcggttgatcactcacctcggcttccaaagtgctggggaaattgattttctatagcattatgttactggatatttctgtaaaatttaaaatgagggaggcagagagacagagagagagcaaaccatgagttggaactctggaatcttgggacatgagacaaattctagataaatctacaaaaatccagaatttacatgttgtgatttttgctgataaagtacaattctaagattgtaaataattgcataatccttccctgggagtttaaatcatttgaactggttctgctgtaatactagaaatacaatcatgaaaaattctaatggtttattgtcacaattgctctgaaaaccttaataatacctattagatattttgcatattacacaggaagaagagtttgaatctcagataaaaacaataaaaatacatgaaaagtctttcatgttagcacagattttaggcatctcgtgttcgggaggttggatctgagacgtgttttgagttggtcatagtgaaggacgcgaggtgtcaattctagtgagagcaatttccaggaagccatgttccgctcttgagcgagcacccactgggcctcatgcaaggtagaaagagcctgcgtacgtcaccctcccatgatgtggtcaacatgtaaactgcatgggcagggcgccaaataacatcctgtgcgctgctgagctgagctggggcgcagccgcctgtctgcaccggcagcaccatgtcgctcatggtcgtcagcatggcgtgtgttggtgagtcctggaagggaatcgagggagggagtgcggggatggagatctggacctggaggtaaagatatgggcctagaggtggagttatgggcctagaggtggagttatgggcctgaagtggagatctgggcctggagtggagatctgggcctggagtggagataggggcctggggtggagatatgtgcctggagtggagatctgggcctggagtggagatatgggcctggggtggagatatgtgcctggggtggagagatgggcctggaggggagatatgggcctggaggggagatgtgggcctagaggtggagtgatgggcctagaagtggagcgatgggcctggagtggagatatgggcctggaggtggagttatgggcctgcagtagagatatgggcctgaagtggagatatgggcctggagtggagatatgggcctagaggtggagttatgggcccggaggtggagttaagggcatgaagtggagatctgggcctggagtggagatatgatcctggagtggagatatgggcctggggtggagatacgggcctggagcagacatacaagcctggaaaggagatatgggcctggagaggagatagaagcctggagtggaaatatgggcctggagtggagatatgagcctggagtggatatatgagcctggagttgagataggagcctggagtggagatatgggcctggagtggacttaccagcctggagaggagatatgggcctggagtggagatacggacctggagtggagatctgggcctgttgtgtagatctaggcctggaggtagagatctgggcctggaggctcagtctctgcacagccgagatccttgttcctgggggcaggtaggcagcgagggtgagtttaccttcagcccagcaagggcctggctgccaagacgcacagcccagtgggggcagcagggtgccctggtttgcctgcagagggatggtccatcatgatctttctttctagggttgttcttggtccagagggccggtccacacatgggtgagtccttccccaaaccttagggtgtcatctccccacataagaggattttcctgaaatgggagggaagtcctgtcggggagtctctcatacactaggaagaggggaccctcggatgctcggcccacatttctgaccttgccttccccggcctttcattccctttcctgagtcaagctctgtgaagactggggtgagactagggtgctccaagatgggtgtgcagggaggaagtggtgtcagcagcagagaaagagagggaagcagtgctaggaacagcaggtcctctgaggacaaaggtgtaactcacaccctccagcgtttccgtgatggtaggggctgcagtgtggctgcggtctttctaccagaaaaggtgaggaaaccacagccatggccctgacattccaaatcctctgatgggggctcagttcatcaattggctgatattccattcacataggacttgccctccatgccgtgtctactttgtgttgttttatatgagtaattttgcagtattaaaatctagtaagagttgcttctccagcaacttgctcaaagttctcagctgacacttgttgtagggagacgccaagtctatgcaggatgggtccttcctgtagccctgggcacccaggtgtggtaggagccttagaaagtggaaatggggagaatcttctgggcactgggagtgaggggcggctccacatcctcctctctaaggcagtgcctccttctcccccaggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggtcagaggctttccgtctgggcttctcactgtcccacctcctgaatcccagagcttctggtgggggtgtccgtcagggtcccatcacccaggccctgactgtatttggggtcaagggagattgaatacaggggaaatgggtgctgtggtgggaagaatcactgtccccaatgatggctacattgtaatccctggagcctgtgactatttatgttacagggcaggggactgaaggggaaggtggagctcaggttgttgatgagttgaccttgagatggggagacagcctggactgtcccactgggctcagtgtaatcacaagggtccacatgagaggtggaggaagaggggagtggggattagagcagtgtagtgggagggagacgctatcagccactgcgggctttgaaggtggaggaagaccactagtcacagaatgcaggtggcctctaagggctggagaagtcaagagaactgattcgctgattctccagagggaacgcagccctgtagacaccttgatttcagcacagggagaactggatccaatttctgtctccagaagtggaaggggtcagtgtgttctctcccgctgccatgtttgtggtaattttctgcagcagcaacaggaaaccaacacaggaacccaggtcaaggacaagttaggaaaccaaacaaggatagccagatgtggtggtgggcacgagtaatccaacgactggggaggctgaggcaagagaatcacttgaactggggatttgttcaaaagagattgattcaggctgctaagagcctggacatgcagcctgtcctcttccacccccacatagacagcaggaaagagattagtgggaaacagatacaacagcccaagagatgaggctgtcttcacagtggcaagggagtcaggggctactggagacagagggacagagaagagggaggaagacagatggaggcacctgcaccaggggatatgggcacagaaaagacacggagatgcagagagggaggagagagacagacacggggaggggaaccctcactcattccaggtgccatggatgggatgataaagagagatgccttctaaactcacaacttctctttctaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtgagagtgtctagacattgttctcattgtcactgggacacagagtgaatgatccaggacttggaacccccaggtggtcatgaggaagataagtgtgggattcttatggaaagagagtgacttggtgaggtctgtaccaacagagacagagaaacaggagacataagtacagaacaggtgtcataacagaggacagacacaggggccatacagggaggtagaaaagagagaaagaggtaaaggagacactcagacagacagacatgtcccagagagaggtgtccttccatgctgactttgctcagagacctggcacaggttagaagtttcatttctgttttacctccacaaagtgttcctaccagaagaacccaaggacacccatatttctgacctgagttgggccctgtggcctcaggccttgtgccacctacagatgccgtgtttattctgacacctctgccttccatgcaatggagagtaatcatcccaggatatcatggcccctgaacaccaacccctgtatgctgtgtgaacttggggtccccagactggattctgaggctcatattccaaataatcccacatatgataggatcgctgagagacacagagaaaaatcagggacaccaaaaagcaaagacataaacacacacaaaatgagccagaagaaggagattaagagattcacagacacataaaaagaaagaaaagagggcagaatggagagaatgatggaaaggaggagagaaaagccccaaaatcagaaccctgagggagggacacaaagacagagaaagataaatatgtggggatggattgcagagattccaaatagaactagagagactgagaggcagagaaagacaaggagacggagagagagagatgatagatggatagatagacgtagatagatgataaataggtagatgatagataatggattggttatagatacatagatgatgactgatagatgatacatagagatgacgatgatgatgatagacacatagatatatacatagatgatacataaatagagacagagaggcagacagagaggtaatagagagagagatagatgatacatatatagataatagatgattgatggatagatagacagacagacaattgatagagagatagataagtgatacataaatatagatgatagataatttgtagatagacacaaaatagataaatagatagaaatgtgcagaaagttatgaacaagacagaaagtgagagactcaaaattaaagaaaaaggaagatcaagtcaaccaatccaaggagggtcagagagaataaaacaatccaaaaagggaaaacatacctcagggtggggaagtgaggtcatagacctagagagacagaaaaggtagaaggaggaaacagatatgaagagagatggggtggagggtgagagagagagagagagcattaggtcatagagcaggggagtgagttctcagctcaggtatgaggggagctatgacaaggaagaacctccctgaggaaactgcctcttctccttccaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtgagaaaagcccatatctctctcatgtcctatgatcctaaatccttagctaaggagcttcctgctgatgatggagaaaagcatggacagatgcagagagaagacacagcaggtgtgagggcggagtcagggcgcaggatggcagacagggcacctccaaaccctccttcatggcctgcatggaggcctccgatcagggctccaggcacccaggcagatggagaaagcggtcaggacagacccagagaaggggagactgggcttagtttggggagatcagaggttccctcagcccctcaatcttatccatttcccagaagcccatcatggcctctcacccacacagagagatatcatcaccagcaacccctacacccttttcttttcattttcaaaaatatttattgaggttaaatgtaactatataatttaccacctttaccatttttaaaagtaaaatctagtggtcataaatacctttatatgctgggtgtggtggttcacggttgtaatctcggcgctttgagaggccaaggaaggtggatcatttaagatcaggaactcgagatcaccctggccaacatgtgggaaattcatctttactaaacagacaagaaaaattagccgagcatgctggcatgcacctgtagtcctagctacttgggaggctgaggcaggagaagcacttaaacccaggaggcagaggttgcactgagccgagatcatgccactgcactgcagcctgggagacagagagagactctgtttctaaataaataaatacatctatattcttttttttgttaccctccacccttcccttcctggcctctggtgtccaccattgtattctccaccttcatgagatccaccttttatctcctgcatgtgggtgagaaatgggaatctttgtaatgacctccagttccatccatgtggctgcaaatgacaggatgttattgtttctatggatgagtagtctccactgtgtgtgtgtaccacagttctctatccattcacccactgatgggcaggtaggttgactccacatcttggctactgtgaacagtgctggaacagtcatatgagtgcagatatcacttcgatacactgatgtcctttcctttggatataaacccagtagtgaaattgctggacactatgaaagttctctttttttttttttcttttttgagaaagagtttccctccttagtccaagctggagtctaagtggtgagatcttggctcattgcaacctgtgcctcctaggttcaaatgattgtcctgactcagcctccctagtagctgtgattacaggtgcacgccaccatgcctggctaatttttgtatttttttagcacagacgggatatcccaattttgggcaggctgctctcaaactcctgacctcaagtgaggtgcctgcctcggtttcccaaagtgctgaagttacaggcataagccactatgcccagcctccttttagttttttaaagaatttccatacttttctccataatagttgtactaatttacattcctaccaacagggtaccagggttctcctttctctaccatcttgccagcatttgttttgcctgtcttgcagtaaaagccattttactttactttattttatttatttatttatgttgagatggagtttcactcatagtctcccaggctggagtgcaagggtgtgatctcagctcactgcaacctccgcctcccgcgttcaactgattctcctgcctcagcctccaaagtagctgggattacaggcatgtgccaccacgcctagctaatttttgtatgtttagtagagagggagtttctccatgatggtcaggctggtctcccgacctcaggtgatccgcccacctccgcctcctgaagtgccggaattacaggcgtgagccaccggcctaaaaggcattttaatgggatgagatgaaaactcatcgcgattgtaatttacatttctctgatgatgagtgatgccgagtactttttcatatacgtgatcgccatttctatgttttgtttgtggagaaatgtctcctcatgtcttttgctcgttttttaattaaattgttttattgagttgtttgagcttcttatatttccagttattaatcccgtctcagatgaatagtttgcaaatatttgctcctattttgtcggttgtctcttcactttcttggtttatcttttgtggtgcagaagttgcttggtttgatgtaatcctaatggtctattttttgctttgattacttgtgttttgaaggttttaaacaaaatgtctttcgtcagacaaatgtcttccccattattttcttctacatgtttcataggttcaggccttagactcatgtttttaatccattttcatttgatttttgtgtatggtgacaggtatagatgcagttttattcctctgcatgtagatatccagttttccccacaccatttattgaaaagactgtcctttcctgattgtaagttctcggcacctttgtcaaagtccattaaatgggctgggtatggtggctcacacctgcaattccagcactttgggaggccgaggcgggtggatcacctgaagccaggagttcaagaccaggctggccaacagagtgaaacctcgtctctactaaaaatacaaaaattagctgagcatggtgaccagtgcctgtaataccactactcgggtgtttgaggcaagagaattgcttgaatccaggaagtggaggttgcattgagctgagattgcacctctgcactccagcctgcatgacagagcaagattctatcacacacacacacaaaaaaagccattggatgtaaatgcatggattatatctgtgttctccattctgtttcattttttatgtgcctttctttatgccaatgtcatgctgttttgcttactacagctctgtaacatatttctaagtcaggtagtgtgatgctcctgttttctctttataccttcaagtctcaagacagtgggcatcgcacacaaaaattatggagaagaggatcccaagactcccagggtccaacattagataacagagtgttggccatgaaccaacctcaaagatttccattgagtagaggacaagcaccctcatttcctcacatctctcctgtcccatgttctaggaaacccttcaagtagttggccttcacccacagaaccaagctccaaatctggtgagtaaaggacccctcttatctctgcttttggaaacctggggaggtggaagccttggatgcaagtgttggctcaaacctcccagctctgtgaatgagggcctgtcttccaccatctctgaactccagacactccaacagtgaaagggatctagggccaccaaagggctcagcgaagtctcttaacctttaatgtcctgcaggtgagacctcctacaagctagaagaatgattgccaatctgacatccttctcaggaaacatgcagtgttttttcttcctgcattcctaactggaggataaattcctggggacttgagagagggaagggaagggaacatctgatgagggcgaggtgttttagagaagttccacttgccaaggaatgaattactgttggtcatgaagcaaccctggctgactcagcagagcaagagccttgccgtaacagagaacagagctcatgcacgcacacttcgactcactgactcattcagccacggccccatgctcaggctgtgcagttggaatcctttcctattgttgccataacaaatttccacaagattcgtgggtgaaaacaaaacggttttttaattatcttacagtgctgtagctcaaagtaggaagtgcatcttactgggctaaaatcaaggtgacagcaaggctgccttccctctgaggattccaggcaagaatctgcttctcacttgtcccagcttctaaaggctcccagttccttggctcctggtccccttcctccttcctcaaagcccacaaagactggtcacatctcacatggcatcactcagacccttcttccttaccacacctctttctctgaatgctgctctcccttcttccttatcttttgaaaacttggggattctattgggttcaccaagatgaaaatccatcataatctcccggaaatcattcaggatacccttgttttaagttcagctgactagcaaccgtaattccatctgcaatcttcattccttctttccatgtaaaataagatattcacaagctatggaggccaggacagggacattttggggtgggacagcattctcctgccttccacgaacggtgaacaagatgcatttggcctctgctcttgggacactgatattgcagatggttaaatgggaggacagaaaatgagtgcacaagtggaccaataaatgaatgatccattgggaagcatctgtgcatgaaatctatttgtttgttcgttcatttatttattgagacagagtctccctctgtcttccaggctacagtgcagtgtcacgatcttggctcactgcaacctgcgtctcctggatccaagtgattctcctgcctcaccctctcgagtagctgggattacaggcaactgccaccatgcccggctaattctttttgtatattttttgtagagaggatgtttcaccatgttggccaagcttgtctgaaactcccaacctcaagtgatccgaccatctcagcaacccaaagtactgggattacaggcgtgagccactttgcccagccagaattcaaaataaataatagataatgctgagtgtataattttgggtgacagagaaggtctcactaatcagatatttgtgacattaatgaaaaacacggattgaacccctgaaagattggcggaaggattttccacacacagctgtcagccgtgaaggcagaaagctgaaaacaatctgatgtggaaggaagaggctctgcctgaaatgctgggaatgaggtggggagaatgacaagacgactgtggagagacggagagcacactgggtacacaggaaactaaggagcaacaaggagtgtgtgtttgacactcacagccattggattcacctcggggtagccaggaatccctacatgattaatagtgactgacatgaaaataagggaggcccaggtgcgtaactggaatctaggagacagtggaaaaggcaattgccgccccactggtgaaatgtggtgctgatttagaccctaagtggatgaagcagatggatataagctatgtttgggaggtagaatcatttgcagggagggcttgctgggtttgagtttcctagttgtttaatccttgctaaattaatttctttctgagatttattcctcctacacataaatcaatacctggcaaaggagtgacagatatatgaggggtggtggaaatgaagggacctattatagcatagtatacaagtctgtgaacggtggctcactcctgtaacccagcactgcaggaggctaaggccagtggattccaagaagtcaggagttcgagaccagcctggccaacatggagaaaccctatctctacatggtgaaaccctatctctcctaaaaatacaaaaattagccgagcatggtggtgcatccctgtaatcccagctcctgctctggaggatgaagcaggagaatgacttcaacccaggaggtggaggttgcagtgagtggagatcgcatcactgcactccagcctgggtgacacaaggagactccatctcaaaaaataaaaataagaaatgcataaatataataaaacacacacgaatgacaaaggcacctgaattcccatcatcatttttctatttctctataattacttctttgatcctttatcttatccattaggcaatcagcctaaaacctcttccgtatttggctttctgtgagcatgagatcatatagaaaatgtgaaagcccgctgaatcctccagcacaaatcctggaatagagaaagtgctctggtcatcacaaaaaaaacttgccccctcacccaaatcccccatctcacccctacttccaatcacctgtggaaatacagatagatcatggggaggtaaatgctaatactccttggagtgagtccagatcttggaatcagagatcagtgccagcactagctcctgctcccctttcctactaattcacaggaggacaggtggtattgaagcaatagatagtcgagggggtggtccttcccccagcctctgaggtagaacagcagcctaacatgtgtctcccgagatcacaaagagtagcacatttcacacgggcttcaacactattttctggctgtttgacataagagaattctacttcgctttttttatattgatttcacttttgtttccttttcttggagaatgcaagttgtttaactcaagaatgccgtggatgtagaaatcctaaagcacattcgctgtgtatcaatcccagtccagtcttcccagagaagactctaaacacctcctggactgcacctgggcctatgccaattcctatcactcaccgtcactccagggagacagaacacacagagaatacgttacataggcaggttcattactaacagataagcagcgagtgacaacagaagcctacatttcaatgtgagccagttccccaaggctcagaaaagctgctcgagacatgtggagtcaccccatttgcagtgtagctgggggaagccagaaagcagcccagcctgggttttgtaccctggagccacaggaagcactcagctaaagcactgcatgacgtcctcctccaggaagaacaggaagacagcccaggctgttctgggacaatcctcctgatctcaggactttgctgtcttagtccatttttgttgctctaaaggaacacttgagcctgggtaacttctaaagaagagattggtttgcctcaccgttctgcaggctgtactggaagcatggcaccagcatctatttcttatgatggcctcaggccgctcccactctggcagaagggaaggagggtctgtctgtgcagagaccacagagatcacacggcaagagagggagcaagggggagggggagcaatggagcttccaagctctttttaacaaccagctctccaggaactaatagagagggaacttgctaaccccgtctccttgggacagcattgatctgttcatgatggatccacctccatgacccaaacacctcccaagaggcccaacctcccacactgggggttaaatttcaatgtgaggtttgaaggggtcaaacatctcaactaaagtagttgtatcctcagcacgttccatggttactatgagagctataactgagaaagcaggaggaagctagatctcccgccatctgggtgcttgtccgaaagagatgctgtaagtggttacctgtcaatcaagaaatgcaagacaattcatatagagaaactgctatgattagcttcttactggtgtctcctcttcttccaggtaaccccagacacctgcacattctgattgggacctcagtggtcatcatcctcttcatcctcctcctcttctttctccttcatctctggtgctccaacaaaaaaagtaagtctcacggggcacaggccagagagctcagggccatgtggggaagcaggatgggagcacacagctgtgtgttcctcactggcaggatggtccctggcccaagacaggagccacagaggcaggactttctagagagagcaccagactccctgcccctgccttcagctcacagaccgttgcctgattctgaactgtatcctcatgtcccctgcagccactcacatccaggagaaggttccatgacaggcagaaagtgggagacagaatcaatgggatgggaactcagagctattcatgggatgggtccttgagctcagagagatagaatgtctgagtctgctgttggcaactgagggacctcaggcacctatggcctccccctgtttgttggtatctgcttatgaaatgaggacccagaagtgccctccgagctcttttgttgacttccgtctcctacagatgctgctgtaatggaccaagagcctgcagggaacagaacagccaacagcgaggtaggtgctcctcggcccagcctcgtggctagtgttattcccaaacagtcctggaaaacgtgagcaccctccctcactcagcatttccctccctcactcagcatttccctctctccaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctcattgcttcaggtaatgtgacactgtattcgctgaaagaaaccgctgttatcattaccatgtccacataaccccatctgttctccgctgggttctcacccctggactctgagcttctggaagcagggtggagcctcatttgtctctgggactccaatttccatccaaagatgcagcacataggaggttccaaggatcgtgaatcacatgaacaagtgatattcttactctctgcaacctggaaagctggcagagtcattccacgatgaaacatttgtagagtcataagccttgctagtctcatctccacggggaca

SEQ ID NO: 231 - DNA, 8282 bp, Homo sapiens
  1st Enhancer of KIR3DL1
gggtactaatagagggagaacttgctaaccccgtcctctggggacagcattaatctattcatgatggatccacccccatgaccaaaacacccctcccaataggcacaactcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaactgctatggttagcttcttattggattcccatcttcctccaggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaaagtctctggcccaaggcaggagccagaggcagagctttctagagagagcaccagacaccctgcccctgccttcagctcacagaccgttgcctgattgtgaactgtatcctcacgtcccctgcagccactcacatccaggagaagattccatgacaggcagaaagtgggagatagaatcaatgggatgggaactgacagctattcatggaatggggtcttgcactcagagagatggaatgtctgagtctggctgttggcagctgagggacctcaggcacctatggcctccccctgtgtgttggtatctgttcatgaaatgaggacccagaagtgccctcccagctgttttgattgcttccgtctcctacagatgctgctgtaatgaaccaagagcctgcgggacacagaacagtgaacagggaggtaggtcctcctagcccagcctcatggatacagtcttattccgaaatagtcctgaaaaatgtgaacaccctccctcactcaggatttccctctctccaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattctttaggtgactctttttttggctgaaagtttccagtgttatcattaccatgtccaaataactccaactgttctccactgggttctcacccctggacttggagcttctggaagcagggtggagcctgatttgtctctgagactccaatttccatccaaagatgcagcacataagaggttccaaggatcgtgaatcacatgaacaagtgatattcttactctctgcagacctggaaagctggcagagtcattccatgatgaaacatttgtagagtcataggccttgttagtctcatctccacggggacacatatcaacacatcatctttcatactataaatatacagtcggtcctctgtatctgtgggatttacaggtgtttattgaaccaaatataaatcaaaaatattcagagaaaaaatccacaaagtttcaaaaagcaaaactatgttgaatggacacaaatgaagctgtgtgtaggctgtatcaggaattataaataatcaagggatgatttcatgtacacaggaggatgtgcatgggttatttgcaaatgctgtgccatttcatgtaagaggcttgagcgtctgcagattgtgctatctgagtggagatcctgaaaccaatcacccacgaatagtgagggatgactgtatataatttttatttctcaattttaaatataaaacataaaaaaattacaataacaagataaaataaacaagtgttttatagtgtgagaatacgtttagatatatttttctctatgtgtaacccttgggcccatgttatttattgagaagacattctattccaccttaaaccacatggcagcctttgtcaactataaagggactgtgtgtacacggatgtattttagacactgttttctgctcagtggctctctctctgtccactctcttgagaatgctgcattttatgcagccttatacaacccctaaaatttggtagctggagtcctctagttatttattataggctatttgctatgctttttttatttttcttgaggcagagtctcgctctgttgcccaggctggagtgcagtggcacgatctcggctcactgcaacttccgcctcccaggttcaagggattccgtgcctcagcctcttgaatagctggcattacaagtgcctgctaccaggcatggctaatttttgtatttttagcagagacatggtttcactatattggccaggctggtctcaaactcctgacctcggttgatcactcacctcggcttccaaagtgctggggaaattgattttctatagcattatgttactggatatttctgtaaaatttaaaatgagggaggcagagagacagagagagagcaaaccatgagttggaactctggaatcttgggacatgagacaaattctagataaatctacaaaaatccagaatttacatgttgtgatttttgctgataaagtacaattctaagattgtaaataattgcataatccttccctgggagtttaaatcatttgaactggttctgctgtaatactagaaatacaatcatgaaaaattctaatggtttattgtcacaattgctctgaaaaccttaataatacctattagatattttgcatattacacaggaagaagagtttgaatctcagataaaaacaataaaaatacatgaaaagtctttcatgttagcacagattttaggcatctcgtgttcgggaggttggatctgagacgtgttttgagttggtcatagtgaaggacgcgaggtgtcaattctagtgagagcaatttccaggaagccatgttccgctcttgagcgagcacccactgggcctcatgcaaggtagaaagagcctgcgtacgtcaccctcccatgatgtggtcaacatgtaaactgcatgggcagggcgccaaataacatcctgtgcgctgctgagctgagctggggcgcagccgcctgtctgcaccggcagcaccatgtcgctcatggtcgtcagcatggcgtgtgttggtgagtcctggaagggaatcgagggagggagtgcggggatggagatctggacctggaggtaaagatatgggcctagaggtggagttatgggcctagaggtggagttatgggcctgaagtggagatctgggcctggagtggagatctgggcctggagtggagataggggcctggggtggagatatgtgcctggagtggagatctgggcctggagtggagatatgggcctggggtggagatatgtgcctggggtggagagatgggcctggaggggagatatgggcctggaggggagatgtgggcctagaggtggagtgatgggcctagaagtggagcgatgggcctggagtggagatatgggcctggaggtggagttatgggcctgcagtagagatatgggcctgaagtggagatatgggcctggagtggagatatgggcctagaggtggagttatgggcccggaggtggagttaagggcatgaagtggagatctgggcctggagtggagatatgatcctggagtggagatatgggcctggggtggagatacgggcctggagcagacatacaagcctggaaaggagatatgggcctggagaggagatagaagcctggagtggaaatatgggcctggagtggagatatgagcctggagtggatatatgagcctggagttgagataggagcctggagtggagatatgggcctggagtggacttaccagcctggagaggagatatgggcctggagtggagatacggacctggagtggagatctgggcctgttgtgtagatctaggcctggaggtagagatctgggcctggaggctcagtctctgcacagccgagatccttgttcctgggggcaggtaggcagcgagggtgagtttaccttcagcccagcaagggcctggctgccaagacgcacagcccagtgggggcagcagggtgccctggtttgcctgcagagggatggtccatcatgatctttctttctagggttgttcttggtccagagggccggtccacacatgggtgagtccttccccaaaccttagggtgtcatctccccacataagaggattttcctgaaatgggagggaagtcctgtcggggagtctctcatacactaggaagaggggaccctcggatgctcggcccacatttctgaccttgccttccccggcctttcattccctttcctgagtcaagctctgtgaagactggggtgagactagggtgctccaagatgggtgtgcagggaggaagtggtgtcagcagcagagaaagagagggaagcagtgctaggaacagcaggtcctctgaggacaaaggtgtaactcacaccctccagcgtttccgtgatggtaggggctgcagtgtggctgcggtctttctaccagaaaaggtgaggaaaccacagccatggccctgacattccaaatcctctgatgggggctcagttcatcaattggctgatattccattcacataggacttgccctccatgccgtgtctactttgtgttgttttatatgagtaattttgcagtattaaaatctagtaagagttgcttctccagcaacttgctcaaagttctcagctgacacttgttgtagggagacgccaagtctatgcaggatgggtccttcctgtagccctgggcacccaggtgtggtaggagccttagaaagtggaaatggggagaatcttctgggcactgggagtgaggggcggctccacatcctcctctctaaggcagtgcctccttctcccccaggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggtcagaggctttccgtctgggcttctcactgtcccacctcctgaatcccagagcttctggtgggggtgtccgtcagggtcccatcacccaggccctgactgtatttggggtcaagggagattgaatacaggggaaatgggtgctgtggtgggaagaatcactgtccccaatgatggctacattgtaatccctggagcctgtgactatttatgttacagggcaggggactgaaggggaaggtggagctcaggttgttgatgagttgaccttgagatggggagacagcctggactgtcccactgggctcagtgtaatcacaagggtccacatgagaggtggaggaagaggggagtggggattagagcagtgtagtgggagggagacgctatcagccactgcgggctttgaaggtggaggaagaccactagtcacagaatgcaggtggcctctaagggctggagaagtcaagagaactgattcgctgattctccagagggaacgcagccctgtagacaccttgatttcagcacagggagaactggatccaatttctgtctccagaagtggaaggggtcagtgtgttctctcccgctgccatgtttgtggtaattttctgcagcagcaacaggaaaccaacacaggaacccaggtcaaggacaagttaggaaaccaaacaaggatagccagatgtggtggtgggcacgagtaatccaacgactggggaggctgaggcaagagaatcacttgaactggggatttgttcaaaagagattgattcaggctgctaagagcctggacatgcagcctgtcctcttccacccccacatagacagcaggaaagagattagtgggaaacagatacaacagcccaagagatgaggctgtcttcacagtggcaagggagtcaggggctactggagacagagggacagagaagagggaggaagacagatggaggcacctgcaccaggggatatgggcacagaaaagacacggagatgcagagagggaggagagagacagacacggggaggggaaccctcactcattccaggtgccatggatgggatgataaagagagatgccttctaaactcacaacttctctttctaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtgagagtgtctagacattgttctcattgtcactgggacacagagtgaatgatccaggacttggaacccccaggtggtcatgaggaagataagtgtgggattcttatggaaagagagtgacttggtgaggtctgtaccaacagagacagagaaacaggagacataagtacagaacaggtgtcataacagaggacagacacaggggccatacagggaggtagaaaagagagaaagaggtaaaggagacactcagacagacagacatgtcccagagagaggtgtccttccatgctgactttgctcagagacctggcacaggttagaagtttcatttctgttttacctccacaaagtgttcctaccagaagaacccaaggacacccatatttctgacctgagttgggccctgtggcctcaggccttgtgccacctacagatgccgtgtttattctgacacctctgccttccatgcaatggagagtaatcatcccaggatatcatggcccctgaacaccaacccctgtatgctgtgtgaacttggggtccccagactggattctgaggctcatattccaaataatcccacatatgataggatcgctgagagacacagagaaaaatcagggacaccaaaaagcaaagacataaacacacacaaaatgagccagaagaaggagattaagagattcacagacacataaaaagaaagaaaagagggcagaatggagagaatgatggaaaggaggagagaaaagccccaaaatcagaaccctgagggagggacacaaagacagagaaagataaatatgtggggatggattgcagagattccaaatagaactagagagactgagaggcagagaaagacaaggagacggagagagagagatgatagatggatagatagacgtagatagatgataaataggtagatgatagataatggattggttatagatacatagatgatgactgatagatgatacatagagatgacgatgatgatgatagacacatagatatat

SEQ ID NO: 232 - DNA, 27638 bp, Homo sapiens
  2nd Enhancer of KIR3DL1
ggagggaggcacagctccacatcctcctctctaaggcggcgcctccttcaccccaaggtggtcaggacaagcccttgctttctacctggcccagccttgtggtgcctccagaacatgtgactcttcagtgtcactctaatcttgggtttaacaacttcagtctgtacaaggatgatggggtgcctgtccctgagctgtacaacagaatattctggaaaagccttttcatgggccctgtgaccacgtcacatgcagggacctatacatgccggggttcacacacacactcccccagtgggtggtcggcacccagcaaccccctggtgatcgtggtcacaggtcagagggctcctgtctgggattctccttgtcccacctcctgaatcccagagcttctggtaggcatgtccttgagggtcccatcacgcaggccctaactgtatttggggtaaagggggattgaatacagggaaatgggtgctgtggtgggaagaataagtgtccccagtgatgactgcattctaatccctggagtctgtgactatttatgttataggggaagggactgaaggggaagatggagctcaggttgttgatgagttgaccttgagatggggagacagcctggactgtcccggtgggctcagtataatcacaagtgtccacatgaaaggaggaggaagaggagagtggggattagagcagcgtagtgggagactccatcagctttgaaggtggatgaaggccataagccatgaatgcaggtggcctatagaggctgggaaagtcaagtaactgattctcctgagtctccagagggaacacagccctgcagatgccttgattttagccctcgaaaaacagggtccgctttctgtctccagaatcggagggggtcagtgtgctctctcctgctgccatgcttctgataattttctacagcagcaacaggaaaccaacactggaacccaggtcaaggacaagttaagaaaagacacaaggatagccaggcatggtggcaggtgcatgtaatcctagcgactcgggaggctgagagcaggagaatcgcttgaacccaggagacagaggttgcagtgagcgtagaccacaccacttcactccagcctgggtgaaggagtgagactctgtctccaaaattaattaattaattaaagaaaccaaacaaagagaaggttggctacaccgagatcagcaagggtgggatgatgatgccaccaccaggctccatccacatagggaggggttgatactcctcaaatcagcacgaggagccagcctatggaaactggcaccatggagaaggcacagacatggcaagagtggctcccagtccccaccaggaacagggtgtgtggacactggtgcctgccttactgatcagttcatacctcctgccaaggattccaattcgtccaaaagagattgaaccaagctgctaagagccgggacgtgcagcctatcctgcttcctcttccactcccacatagacagtaagaaagacattagtgtgaaatagatacaacagcccaagagatgaggctgagcccagtgggaagggaatcacagctactagagacagagggacagagaagagggagggagacagatggaaggacctgcaccaggagttatgggcacagaaaagaacatgaagacacagagaggaagcagagagacagacaccagcgaagggaaggctcactcattccaggtgccatggatgggatgataaagagagacaccttctaaactcacaacctctcttcctaggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtgagagtgtccagacattcttctcattgtcattgggatgcagagtgaatgatccaggacttggagacccaggtggttgtaaggaagatgagcttggtattcttatggagagagactgacttggtgaggtctgtgccaacagagacagagaaacaagagacacaagtacagaccaggtgtcataacagaggacaaacacaggggccatacagggagttagaaaagacagaaagagttaaaggagacagacagacatgtcccagacagaggtgtccttccatgctgactttgctcagagacctggcacaggttagaagtttcatttctgttttacctccacaaagtgttctctaccaggagaacccaaggacacccatatttctgacctgagttgggccctgtggcctcaggccttgtggcacctacagatgccatgcttattctgacacctctgacttccatgcaatggagaataatcgtcccaaaatatcatggccccagaacaccaacccctgtatgctgtgtgaacttgtggtctccagactggattctgaggctcacattccaaataaccccacatatcacatatgagaggatcactgagaagcacagagagaaatcagggacaccaaaaagcaaagacataaacacacagagaaagagccagaggaaggagattgagagactcacagacacataaagagagagaagagggcagagaagtggagagaatgatggaagagagcagagaaaaccactaaaattagagtcctgagggcgaggcacaagggcatagaaagatggagatgtggggatgaattgcagagattccaaagagaactagagagaccgagaggcagagcaagacagatgatagatggatagatacagatagatgatggatagatatagatagatgatatataggtagatgatagataataggttatagatacatagatgatgattgattgattcattaatagatgatacatagagatgatgatgatgaagatagatggatagataatacatagagatagagaggaagacaaagagagaaataatagagagagagagatgatacatatatatagataatagatgattgacggatagacaattgatagataaatagatgatatatagatatagatgacaggtagagaatttgtagataggcaccgaatagataaatagatggattgatagataatagatagaaatatgcagaaagttatgaacgggacacaaactgagaaactcagagttaaaaaaagtaacatcaagtcaaccaatccaaggagagccagagagaataaaacaatccaaaaacggaaaacataactagaggtagggaagtgaggtcagagacctacagagacagagaaggtggaaggaggaaatagacatgaagagagatagggtggagggtgagacagagaaagagagcattaggccatagagcaggggagtgagttctcaggtcaggtgtgaggggagctgtgacaaggaagatcccccctgaggaaactgccccttctccttccaggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggtgaggaaaccccatatctgtcccatgtcctatgatcctagagccttagctgaggagcttcctgctgatgatggagagaagcatggacagatgcagagagaagacgcagcatgcctgtgagggagggatcagggcgcaggatggcacacacagcacctccaaaccctcctgcatggcctgcatggaggcctccgattagggctccagaaacccaggcagatgtagaaagcggtcaggagagacccagagaaggggagactgggctcagtttggggagatcagaggttccctcagcccctcaaccttacccatttcccagaagcccttcctggcctctcacccacacagagatgtcatcaccagcaacccctacatccttttctttttgtttgaaaaaatattcattgaggttaaatatacctatatagcttaccacttttaacatttttttttttttgaggtggagtctagctctgtctcctatgctggaatgcagtggcacaatctcagctcactgtaacctccgcctcctgggttcaagcgattctcctgcctcagccacctgagtagctggtactacaggcgcccatcaccacgccgggctactttttgtatttttagtagagagggggtttcaccatgttggtcgagctgctctggaactcctgaccacgtgatccacccgcctcaggctcccaaagtgctgggattacaggcatgagccaccgcgcccggccacgtttaccaattttaagtgtaaggtctagtggtcataaatacatacatataaattttttgtttgtttgttttatcctccacccttttcttcctggcctctggtagccaccattctactctctatcttcatgagatccaccttttagctcctgtatatgggtgagaaatgagaatatttgtaatgacttccagttccatccatgtggctgcaaatatcaggatgttattctttctatggatgagtagtctccgctgtgcgtatgtactacattctctctatccattcatccactgatgggcaggtaggttgactccacatcttggctactgtgaagagtgctgcaccaatcatacgagtgcagatatcacttcgatacattgatttactttcctttggatataaacccagtagtgaaattgctggatactatgaaagttctctttttagtttttcgtttgttgttttgtttttgtttttgagacagtttccctctgtgcccaggctggagtacaagtgatgtgatcttggctcattgcaacctccgcctcctgggttcaaatgattttcctgcctcagcctccctagtagctgggattacaggtgcacgccaccatgccgggatactttttggttttttttagtgtacatggggtttccccaggttggctaggctgctctcaaactcatgacctcaactgaggtgcccgcctcggtctcccaaagtgccgggattacaggcatgatccacttcatccaacctctttttagttctttaaaggacttccatacttttctccgtaatggctgtactaatttacactcctaccaacagggtaccagggttctcctttctctaccaccttgccagcatttgttttgcctgtcttgcagctaaaagccattttattttatttcattttattttgagatggagtttcgctcttgtcacccaggctggagtgcagtggtgcgatctcggctcaccgcaacctccacctcccaggttcaagcgattctcctgcctcagcctcccgagtagctggaattacaggcacacgccaccacgcccgactaatttttgtatttttagtagagacagcgtttctccatgtgggtcagactggtctcaaactcccgaccttatgagattcgcccacctcgggctctcagagttctaggatgacagacgtgagccacctcgcccggcctaaaagccattttaatggggtgagatgaaaactcactttgattttaattcgcgtttctctgatgatgagtgatactgagcactttttcgtatgtggggaaatttcatgtcttttgctcctttttcaattaaatcatttgttttattgagttgtttgagcttcttatacttctagttattaatcccgtctcagatgcatagtttgcacatatttgctcccaatctgtgggttgtctcttcactttgttggtttatttttagcggtgcagaagttgcttagtttgaggtaatcccaatggtctatttttgcttcgattacttgtgttttgaaggtttaaaacaaaatgtcttccttcagacaaatgtactggagcatttccccaatattttcttctacgtgtttcacaggttcaggccttagactcacatctttaatccactttcatttgatttttgtgtatggtgacaggtagaggtgcagtttcattcctctgcatgtagatgtccaggtttccctgcactgtttattgaaaaaactgtcctttcctgattgtgagttcttggcacctttgtcaaagtccattggatgggctgggcatggtggctaacaccagcaacttcagcactttgggaggccaaggctggtggatcacctgaggacaggagtacaagattactctggccgacgtgatgaaacctcgtctccactaaaaatataaaaattagctgagcatggtggtcagcacctgtaatactactactcaggagtttgaggcaagagaattgattgaacccaggaggctgaggttgcagtgaaccgagattgcacctctgcactccagcctgggtgacagagcgagactccatctcaaaagaaaaaataaaaaaaattggatgtaaatgcatggattatatctgtgttcttcattctgctccgttgttctatgtgcctttcttcatgccaacatcatgctgttttgcttactacagctctgtaacatattttgagatcaggtagtgtgatgctcctgttttctctttataccttgaagtctcaagacagtgggcgtcacatacaaaaattatggaagaaaggatccctggactcccagggcccaatgttagataacagagtgttggccatgaaccaaactcaaagatttccactgagtagaggacagacaccctcatttcctcacctctctcctgtctcatgttctaggaaacccttcaaatagttggccttcacccactgaaccaagctccaaaaccggtgagtacaggaccctcttatatccgcttttggaaccctggggaggtggaaaccttggattcaggcgttgactcagcatctcacagctctgacattgtacgcctgtcttctaccatctccgaactccagatactccaacagcgaaagggatctgggcccaacacagggctcagtgaaatctcttcatctctcattttatggagctgagacctcctacaagctagaagaatgattgccaatctgacatccttctcaggaaaaacgcaatgtttgttctgcttgcattcctaactggaggataaattcctgggggcttgagagagggaagggaagcgaacatctgatgagggcgaggtgttttagagaagttccacttgccaaggaatgagctcctgttggtcatgaaacaaccctggctgactcagcagagcaagagccttgccgtaacagagaacagagctcatgcacgcacactttgactcactgacttattcagccacggccccatgctcaggttgtgcagtgtggaagcttttcctattgttgccataacaaatttccacaagattcgtgggtgaaaacaaaacggttatttaattatcttacagtgctctagctcaaagcatgaagtgcatctcactgggctaaaatcaagatgacagcaagcctgccttccctctgaggattccaggcaagaatctgcttctcacttgtcccatcttataaaggctcccagttccttggctgctggtccctttcctccttcctcaaaacccacaaagactggtcacatctcacatggcatcactcagacccttcttccttaccacacctctttctctgaatgctgctctcccttcttcctcatcttttgaaaacttggggattctattgggttcaccaagatgaaaatccgtcataatctcccggaaatcattcaggatacccttgttttaagttcagctgattagcaaccataattccatctgcaatcttcattcctcctttccatgtaaaataacatattcacaagctatggaggctaggacagggacattttggggtgggacagcattctcctgccttccacaaatggtgaacaagatgcatttggcctctgctcttgggacactgatattgcagatggttaaatgggaggacagaaaatgaatgcacaagtggaccaataaatgaatgatccattgggaagcatctgtgcatgaaatctatttgtttgttcgttcgtttgtttattgagacagagtctccctctgtcttccaggctacagtgcagtgtcacgatcttggctcactgcaacctgcgtctcctggatccaagtgattctcctgcctcaccctctcgagtagctgggattacaggcaactgccaccatgcccggctaattctttttgtatattttttgtagagaggatgtttcaccatgttggccaagcttgtctgaaactcccaacctcaagtgatccgaccatctcagcaacccaaagtactgggattacaggcgtgagccactttgcccagccagaattcaaaataaataatagataatgctgagtgtataattttgggtgacagagaaggtctcactaatcagatatttgtgacattaatgaaaaacacggattgaacccctgaaagattggcggaaggattttccacacacagctgtcagctgtgaaggcacaaaggtgaaaacaatctgatgttgaaggaagaggctctgcctgaaatgctgggaatgaggtggggagaatgacaagatgactgtagagagatggagagcactctgggtacacaggaaactaaggaggaacaaggagtgtgtgtttgacactcacagccattggattcacctcggggtaaccaggaatccctacatgattaatagtgactgacaagaaaataagggaggcccaggtgcgtaactggaatctaggagactgtggaaaaggcaattgccgccccactggtgaaatgtggtgctgatttagacactaaatgaatgaagtagatggatataagatatgcttgtgaggtagaatcattggctggaaaggcttgctgggtttgattttcctacttgtttaatcctcgcttaattaatttctttctgagatttattcatcctacacataaatcaatacctggcaaaggagtgacagatatatgaggggtggtggaaatgaagggacctattatagcataatatacaagtctgtgaacggtggctcatgcttgtaacccagccctgcaggaggccaaggcgggtggattccatgaagtcaggagttccagaccagcctggccaacatggtgaaaccctatctgtactaaaaatacaaaaattagccgagcatggtggtgcatccctgtaatcccagctcctactctggaggatgaagcaggagaatgacttcaacccaggaggtggaggttgcagtgagtggagattgcatcactgcactccagcctgggtgacacaaggagactccgtctcaaaaaataaaaataagaaatgcataaatataataaaacacacacgaatgacaaaggcacctgaattccaatcatcatttttctatttctctataattacttctttgatcctttatcttatccattaggcaatgagcctaaaacctcttccctatttggctttctgtgagcatgagatcacatagaaaatgtgaaagcccgctgaatcctccagcacggatcctggaatagagaaagtgctctggtcatcgcaaaaaaaaacttgcccactcacccaaatcccccacctcacccctacttccaatcacctgtggagattcagatagaccatggggaggaaacattaatactccttggagtgagtccagatcttggaatcagagatcagcgacagcactagctcctgttcccctttcctactaattcacaggaggacaggtggtattgaagcaatagatggtcgagggggtggtccttcccccagcctctcgggtagaacagcagcctaacatgtgtctcccgagatcacaaagagtagcacatttcacacgggcttcaacactatttcctggctgtttgacataagagaatcttgcttcgctatttttaatcgtgatttcacctttgtttcctttccttggtgaatgcaatttgtttgactcaagaatgctgtggatgtagaaatcctaaagcacattcgctgtgtatcaatcccagtgcagtcttcccagagaagactctaaacaaatcctggactgcacctgggcctatgccaattcctatcactcaccgtcactccagggagacagaacacacagagaatacgttacataggcaggttcattactaacagataagcagcgagtgacaacagaagcctgcatttcaatgtgagccagtccctcaaggctcagaaaagctgctcgggacatatggagtcaccccatttgcagtgtagctgcgggaagccagaaagcagcccagcctgggttttgtaccctggagccacaggaagcactcagctaaagcactgcatgacgtcctcctccaggaagaacaggaagacagcccaggctgttctgagacattcctcctgatctcaggatgttgctatcttagtccatttttgttgctctaaaggaacacttgagcctgggtaacttctaaagaaaagagattggtttgcctcacagttctgcaggctgtactggaagcatggcaccagaatctatttctcgtgacggcctcaggctgctcccactctggcagaagggaaggagggtctgtctgtgcagagaccgcagagatcacacggcaagagagagagtaagggggagagggagcgatggagcttccaagctctttttaacaaccagctctccaggaactaacagagggggaacttgctaaccccgtctccttgggacagcattgatctgttcatgatggatccacctccatgacccaaacacctctgaagaggcccaacctcccacaatgggggtgaaatttcaatgtgaggtttgaaagggtcaaacatctcaactaaagtagttgtatcctcagcacgttctatggttactatgagagctataattgagaaagcaggggaaagctaggtctcccgccatttgggtgcttgtcctaaagagacgttgtatgtggttacctgccaatcaagaaatgcgagacaattcataaagaggaactgctatgattagcttcttattggtgtctcctcttcttccaggtaaccccagacacctacatgttctgattgggacctcagtggtcaaaatccctttcaccatcctcctcttctttctccttcatcgctggtgctccgacaaaaaaagtaagtctcacgaagcagaggccagagagctcagggccatgtggggaagcaggatgggagcacgcggatgtgtgttcctcaccagcaggatggtccctggcccaagacaggagccacagaggcaggactttctagagagagcaccagattcccttcccctgccttcagctcacagaccattgcctgattctgaactgtatcctcacgtcccctgcagccactcacatccaggagaaggttccatgacaggcagaaagtgggagatagaatcaatgggatgggacctcagagctattcatgggatgggtccttgaactcagagagatagaatgtctgagtctgctgttggcaactgagggacctcaggcacctatggcctccccctgtttgttggtatctgcttatgaaatgaggacccagaagtgccctccgagctcttttgttgacttccgtcttctacagatgctgctgtaatggaccaagagcctgcagggaacagaacagtgaacagcgaggtaggtgctcctccgcccagcctcgtggctagtcttattcccaaagagtcctgaaaaatgtgagcaccctccctcactcagcatttccctctctccaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatggtttcggtaacgagactcttttcttgcctaaggcttccggtgttatcattaccatgtccacataaccccatctgttctccattgggttctcagccctggactctgagcttctggaagcagaatggagcctgatttgtctctgagactccaatttccatccaaagatacagcacataggaggctccaaggatcgtgaatcacatgaacaagtgatattcttactctctgcagacctggaaagctggcagagtcattccacgatgaaacatttgtagagtcataggccttgttagtctcatctccacggggacacatatcaacatatcatctttcataatataaatatacagtcggtcctccatatctgtggggtttacaggtgtttattgaaccaacaataaatcaaaaatattttcagaaaaaaatccccgaagtttcaagaagcaaaaaactatgttgaatcgacacaaattgagtggcgtgtaggctgtgtcaggaattataagtaatcaagggatgatttcatgtatacaggaggatgtgcatgggttctatgcaattgctatgctattttttttttttttttgagacagtctcactctctcacccaggctggagtgcagtggcatgatctcagctcactgcaacctccgcctcccaggttcaagcgattgtcttccctcagcctccccagtagcctcccctaggattacaggcacgtgccaccatgcacagataaatttttttgtgtgtgtatttttagtagagacggggtttcagaatgttggaccagctggtcttgaactcctgacctcgtgatctacccaactcagcctcccaaagtgctgggattacaggcgtgagccacggtgcccagcttcgctatgccatttcatgcaaggggcttgagcatctgcagattttggtatctgaatggggatcctggaaccaatcacccaggaatagtgaaggaccacagtatataatttttatttgtcaatcttaaaaataaagcataaaaagtttacaacaacaagataaaaaataagaagtgtctttatagtgtgaggataagtttagatttattttttcctacgtgtaaccctatggtcctgtgttatttgttgagaaaatattctattccaccttaaactacatggcagcctttgtcaactataaagggactgtgtatccacagatgtattttagacacagttttctgcccagtggttctctgtatcccctctcatgaggatgctgcatttcatataaacttatagaaccccttaaaatttggtaacctgagttctctgatttgttattataggttatttagtttgcttttttttttctttcttgagacagactcttcctctgtcacccaagctggagttcagtggcttgagctcagctcactgcagcctccgcctcccaggttcaagcaattctcgtgcctcaggtttagtactagaaactcatcaggaaaattagaatggctttttgtcacaattactctgataatgttaataatacctcttagatattttgcacattacacatgaagaaaagtttgaatctcagataaaaacaaaaatacatcaaaagtctttaatgtaagcacagaattcaatcacctcatgtgtgagaggttggatctgagacgtcttttgagtctggtcatagtgaaggatgcaaggtggcaattgtagtcacaacaatttccaggaagccatgttccgctcttgagcgagcacccactgggcctcatgcaaggtagaaagagcctgcgtacgtcaccctcccatgatgtggtcaacatgtaaactgcatgggcagggcgccaaataacatcctgtgcgctgctgagctgagctggggcgcggcctcctgtctgcaccggcagcaccatgtcgctcacggtcgtcagcatggcgtgcgttggtgagtcctggaagggaatagagggagggagagtggggatggagatctcggcctagaggtaaagatatgggcctggagtggagatatgggcctggagtggagatatgggcctgggtgtggagatatgggcctggaggtgtaaatatgggcctggagtggagatatgggcctggaggggagatatgggcctgggtgtggagatatgggcctggagtggagatacgggcctggagtggagatatgggcctggagtggagatatgggcctgcaggtggagatctgggcctggagtggagatatgggcctggagtggagatatgggtctgatgtggagatatgggcctggagtggagatatgggcctggagtggagatatgggcctagaggggagatctgggcctggagtggagatatgggtctgatgtggagatatgggcctggagtggagatatgggcctggagtggagataggggcctggagtggagatatgggcctggagtggagatctgggccaggaagtgttgatctgggcctggagcctgggtctctccacagctgagagccctgttcttggcagcaggtagcagggaggctaagtttaccttcagcccagcaagggcctggctgccaagacacacagtgcagtgggggcagcagggtgccctggtttgcctgcagttggatcgtctatcatgatctttctttccagggttcttcttgctgcagggggcctggccactcatgggtgagtccgtccccaaaccttagggtgtcatctccccacataagaggatttttctgaaacaggagggaagtcctgtcggggagtctctcataaactaggaagaggggacccttggatactcggcccacatttctgacctcgccctccctggcctttctttccctttcctgagtcaagctctgtgaagactggggtgagactggggtgctccaagctggggtgtgcagggaggaagtggtgtcagcagcagagaaagagagggaagcagtgctaggaacagcaggtcctctgaggacaaaggtataactgacaccctccagcgtttccgtgacggtaggggctgcagtgtggctgcggtctttctaccagaagaggggggaaaccacagccatggccctgacattccaaatcctctgagggggctcagttcatgaattggctgatattccattcacataggacatgccctccatgccgtgtctactttgtgttgttttatgtgagtaattttgcagtattaaaatctagtaagagtcacttattcagcacttgctcaaagttctcagctgacacttgttgtagggagacgccatgtctatgtggggtgggtccttcctgtagccctgggcacccaggtgtggtaggagccttagaaagcggaaatgggagaatcttctgagcacagggagggaggggtggctccacatcctcctctctaaggcagtgcctccttctcccccaggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggtcagaggctttctgtctgggcttctcactgtcccacctcctgaatcccagagcttctggtgggggtgtccatcagggtcccatcacccaggccccaactgtatttggggtcaagggagattgaatacaggggaaatgggtgctgtggtgggaagaataactgtcgccaatgatggctacattgtaaaccctggagcctgtgactatttatgttatagggcaggggactgaaggggaaggtggagctcaggttgttgatgagttgaccttgagatggggagacagcctggactgtcctgctgggctcagtgtaatcacaagggtccgcgtgagaggtggaggaagaggggagtggggattagagcagtgtagtgggagggagacgctatcagccactgtgggctttgaaggtggaggaaggccactagtcacagaatgcaggtggcctctaagggctggagaagtcaagagaactgatttgctgagtctccagagggaacgcagccctgcagatgccttgatttcagcacagggagaactggatccaatttctgtccccagaagtggaaggggtcagtgtgttctctcctgctgccatgtttgtgataattttctgcagcagcaacaggaaaccgacacaggaacccaggtcaaggacaagctaggaaaccaaacaaggatagccaggtgtggtggtgggcacgagtaatccaacgactggggaggctgaggcaagataatcacttgaaccggggaggcagaggttgcagtgagccaagacaacaccactgcactccagcctgggtgaaaaagtgactgtctcaaaaataaattaattaatcaattaattaaagaaaccaaacaaggagaaggttggctaccgtgggatcagcaagggtgggatgctgatgccaccaccaggctccatccacataggaaggggttgatgctcctggaaccagcaccagggaccaccctatggaagctggggccatggagaaggcacagacatggcaggagaggctcccaatccccatcaggaacagggtgtgtggacactgatgtctgccttactgatgagttgatacctctgccagagactccaatttgttcaaaagagattgattcaggctgctgagagcctggacatgcagcctgtcctcttccacccccacatagacagcaggaaagagactagtgggaaagagatacaacagcccaagagatgaggctctcttcacagtgggaagggagtcaggggctactggagacagagggacagagaagagggaggaagacaaatggagggacctgcaccaggggatatgggcacagaaaagacacggagacacagagagggaggagagagacagacctctgggaggggaaccctcactcattccaggtgccatggatgggatgataaagagagatgccttctaaactcacaacttctctttctaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtgagagtgtccagacattcttctcattgtcattgggacacagagtgaatgatccaggacttggaacccccaggtggtcatgaggaagataagcgtgggattcttatggagagagactgactcggtgaggtctgtaccaacagagacagggaaacaggagacataagtacagaccaggtgtcataacagaggacagacacaggggccatacggggaagtagaaaagagagaaagaggtaaaggagacactcagacagacagacatgtgccagagagaagtgtccttccatgctgactttgctcagagacctggcacaggttagaagtttcatttctgttttgtctccacaaagtgcttctacgaggagaacccaaggacacccatatttctgacctgagttgggccctgtggcctcaggccttgtggcatctacagatgccatgtttattctgacacctctgccttccatgcagtggagccataattatcccaggatatcatggccccagaacaccaacccctaaatactgtgtgtacttggtgtccccagactagattctgaggctcatattccaaataatcctacatataataggatcactgagagacacagagataaatcagggacttcaaaaagcaaaggcataaacacacagagaatgagccagaggaaggggattgagagactcacagacacacaaaaagaaagaaaagagggcagaggagtggagagaatgctggaagggaggagagaaaagccccaaaatcagaaccctgagggaggggcacaaagacagagaaagataaagatgtggggatggattgcagagattccaaatagaactagagagactgagaggcagagaaagacaaggagatggagagagacagatgatagatggatagatagatatagatagatgataaataggtagatgatagataatggataggttatagatacatagatgatgattgatagatgatacatagagatgatgatgatgatgatgaagatagatagaagacacatatataaatatatagatacatagatgatacatagagactgacaggcagacagagaggtaatagagagagagagagatgatacatagatacagataatacatagatgattgatggatagacagatagacaattgatagataaatgatacatagatatagatgacagataatttgtagatagacacaaaatagatagatagataatagatagaaatatgcagaaagttatgaacaagacagaaagtgagagactcagaattatagaaaaaggaagatcaagtcaaccaatccaaggagagtcagagagaataaaacaatccaaaaagggaaagcatacccaggggtggggaagtgaggtcagagacctagagagacagagaaggcggaaggaggaaatagacatgaagagagttggggtggagggtgagagagagagagagcattaggtcatagagcaggggagtgagttctcagctcaggtatgaggggagctgtgacaaggaagaacctccctgaggaaactgcctcttctccttccaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtgaggaaaacccgtgtctgtcccatgtcttatgatcctagagccatagctgaggagcttcctgccgatgatggggagaagcatggacagatgcagagagaacacgaagactgggtgtgaggggggggtcagggtgcaggatggcagacagggcacctccaaaccctcttgcatggcctgcatggaggcccatggtcagggctccaggcacccaggcagatggagaaagcggtcaggacagacccagagaaggggagactgggctcagtttggggagatcagaggttccctcagcccctcaaccttacccatttcccagaagcccatcctggcctctcacccacacagagagatgtcatcaccagcaacccctacactcttttcttttcattttcaaaaatatttattgaggttaaatgtaactatataatttaccaactttaccatttttaaaagtaaaatctagtggtcataaatacctttatatgctgggtgtggtggttcacggttgtaatcttggcgctttgagaggccaagaaaggtggatcatttaagatcagggactcgagatcagcctggccaacatgcgggaaattcatctttactaaacagacaagaaaaattagccaagcatgccggcatgcacctgtagtcctagctacttgggaggctgaggcaggagaagcacttaaagccaggaggcagaggttgcactgagccgagatcatgccactgcactgcagcctgggagacagagagagactctgtttctaaataaataaatacatctatattcttttttttgttaccttccacccttcccttcctggcctctggtatccaccattctattctctaccttcatgagatccaccttttatctcctgcatgtggtgagaaatgggaatctttgtaatgacctccagttccatccatgtggctgcaaatgacaggatgttattgtttctatggatgagtagtctccaccgtgtgtgtgtactacagttctctatccattcacccactgataggcaggtaggttgactccacatcttggctactgtgaacagtgctggaacagtcatatgagtgcagatatcacttcgatacactgatgtcctttcctttggatataaacccagtagtgaaattgctggacactatgaaagttctctttttttttttttcttttttgagaaagagtttccctccttagtccaagctggagtcaaagtggtgcgatcttggctcattgcaacctctgcttcctaggttcaaacgattctcctgactcagcctccctaatagctgtgattacaggtgcacgccaccatgcctgactaattcttgtattttttagcacagacgggatatcccaattttgggcaggctgctctcaaactcctgacctcaagtgaggtgcctgcctcggtttcccaaagtgctgaagttacaggcataagccactatgcccagcctccttttagttttttaaagattttccatacttttctccataatagttgtactaatttacattcctaccaacagggtaccagggttctcctttctctaccatcttgccagcatttgttttgcctgtcttgcagataaaagccattttactttactttatttatttatttatttatgttgagatggagtttcactcatagtcgcccaggctggagtgcaagggtgtgatctcggctcactgcaacctctgcctcccgcgttcaactgattctcctgcctcagcctccaaagtagctgggattacaggcatgtgccaccacgcctagctaatttttgtatgtttagtagagagggagtttctccatgttggtcaggctggtctcccgacctcaggtgatccgcccacctccgcctcccaaagtgctggaattacaggcgtgagccaccggcctaaaaggcattttaatgggatgagatgaaaactcatcgcgattgtaatttacatttctgtgatgatgagtgatgctgagcactttttcatatacgtgatcgccatttctatgttttgtttgtggagaaatgtctcctcatgtcttttgctcgttttttaattaaattgttttattgagttgtttgagcttcttatatttccagttattaatcccatctcagatgaatagtttgcaaatatttgctcctattttgtgggttgtctcttcactttgttggtttatctttggtggtgcagaagttgcttggtttgatgtaatcctaatggtctattttttgctttgattacttgtgttttgaaggttttaaacaaaatgtctttcatcagacaaatgtcttccccattattttcttctacatgtttcataggttcaggccttagactcatgtttttaatccattttcatttgatttttgtgtaaggtgacaggtatagatgcagttttattcctctgcatgtagatatccagttttccccacaccatttattgaagactgtcctttcctgattgtaagttctcggcacctttgtcaaagtccattaaatgggctgggtatggtggctcacacctgcaattccagcactttgggaggccgaggcgggtggatcacctaaagccaggagttcaagaccaggctggccaacagagtgaaacctcgtctctactaaaaatacaaaaattagctgagcatggtgatcagtgcctgtaataccactactcaggagtttgaagcaagagaatttcttgaatccaggaagtggaggttgcattgagctgagattgcacctctacactccagcctgcatgacagagcaagattctatcacacacacacaaaagaaagccattggatgtaaatgcatggattatatctgtgttctccattctgttccattttttatgtgcctttctttatgccaatgtcatgctgttttgcttactacagctctgtaacatatttctaagtcaggtagtgtgatgctcctgttttctctttataccttcaagtctcaagacagtgggcatcgcacacaaaaattatggagaaaaggatcccaagactcccagggtccaacattagataacagagtgttggccatgaaccaacctcaaagatttccattgagtagaggacaagcaccctcatttcctcacatctctcctgtcccgtgttctaggaaacccttcaagtagttggccttcacccacagaaccaagctccaaatctggtgagtaaaggacccctcttatctctgcttttggaaacctggggaggtggaagccttggatgcaagtgttggctcaaacctcccagctctgtgaatgagggcctgtcttccaccatctctgaactccagacactccaacagtgaaagggatctagggccaccaaagggctcagcgaagtctctttacctttaatttcctgcaggtgagacctcctacaagctagaagaataattgccaatctgacatccttctcaggaaaaatgcagtgttttttctgcctgcattcctaactggaggataaattcccgggggcttgagagagggaagggaagggaacatctgatgagggtgggtgttttagagaagttccacttgccaaggaatgaattactgttggtcatcaggcaaccctggctgactcagcagagcaagagccttgccgtaacagagaacagagctcatgcacgcacacttcgactcagtgactcattcagccacagccccatgctcaggctgtgcagtgtggaagcttttcctattgttgccataacaaatttccacaagattcgtgtgtgaaaacaaaacggttatttaattatcttacagtgctgtagctcaaagcatgacgtgcatgtcactgggctaaaatcaaggtgacagcaaggctgccttccctctgagggttccaggcaagaatctgcttctcacttttctcagcttctagaggctcccatgttccttggctcctggtacccttcctccttcctcaaagcccacaaagactggtcacatctcacatggcatcactcagacccttcttccttaccacacctctttctctgaatgctgctctcccttcttgcccttcttttgaaaacttggggattctattgggttcaccaagatgaaaatccatcataatctcccggaaatcatccaggataccctccttttaagttcagctgactagcaaccataattccatctgcaatcttcattcctcctttcatgtaaaataacatattcacaagctatggaggctaggacatggacatttttggggtgggacaacattctcctgccttccacaaacagtgaacaagatgcatttggcctctgttcttgggacactgatcttgcagatggttaaatgggagggcagaaaatgtaggcacaaggggaccaataaatgaatgatctattgagaagcatctgtgcatgaaatctatttatttatgtatttacctacttgtttattgagacggagccttgctctgtcgtccaggctagagtgcggtggcatgatctcggctcactgcaacctccacctcctgggctgaactgatctcctccctcagcctctccagtagctgggattacagaccacaaccaccacgcccggctaactctttttgcatattttctgtagagaggatgtttcaccatgttggccaggctggtctcaaattcccaacctcaggtgatccaatagcctctgcctcccaacacgctgggataagaggcatgagccacggggccaagccaaattttcaaatcaataatagataatgctgagtgtattatttcaggtgacagagaagttctcactaatcagatatttgtgacattaatgaaaaacacggattgaacccctgaaagattggcggaaggattttgcacacacagctgtcagccgtgaaggcacaaaggtgaaaacaatctgatgtggaaggaagaggctctgactcaaatgctgggaatgaggtggggagaatgacaagatgactgtagagagacggagagcacactgggtacacaggaaactaaggagcaacaaggagcgtgtgtttgacactcacagccattggattcacctcgaggtaaccaggaatccctacatgattaatatgactgacatgaaaataagggaggctcagttgcataactggaatctaggagaccgtggaaaaggcaattgccgccccactggtgaaatgtggtgctgatttagacactaaatgaatgaagtagatggatataagatatgtttgtgaggtagaatcattggctggaaaggcttgctgggtttaatttttcctggtagtttaatcctcgcttcactaacttatttctgagatttatttctcctgcatctaaatcaatacctggcagaggagggagagctagatgaggggtggtgcaaatgaagggacctagtatagcataatatacaaggctgtgaacggtggctcacgcctgtaacccagcacttcaggaggccaacgcgggtggatcacatgaagtcaggagttcgagaccagcctggccaacatggagaaaccctatctctactaaaaatacaaaaattaaacaggcatgatggtggtgcatgactgtaatcccagctactctggaggaggaagcaggagaatgacttcagccctggaggcagaggttgcagtgagtggagatcgcatcactgcacaccagcctgggctacacagggatactctgtctcaaaaaataaaaataaaaaatacataaatataataatatacacaaatgatgcaggcacctgaattccaatcatcatttttctattcctctataattacttctttgatcctttatcttatccattagaaaatcagcctaaaacctcttccatatttggctttctgtgaacatgagatcatatggaaaatatgaaagccccctgaacccaccagcacaggccctgaaatagggaaagtgctctgttcatcacaagaaactttccccctcacccaaatcccccacctcacccctacttccaatcacctgtggagatacagatagatcatggggaggtaaacgctaatactccttggagtgagttcagatcttggaatcagagatcagcaccagcactagctcctgctcccctttcctactaattcacaggaggacaggtggttttgaagcaatagatggtggagggggtggtctttcccccagcctctcaggtggaacagcagcctaacatgtgtctcgcgagatcacaaagagtagcacgtttcacatgggcttcatcattatttcctggctgtttgacataagagaattctactttgcttttttgatcttgatttcacttttgtgtccttttcttggagaatgtaatttgagtcaagagggttgtggatgtagaaactgtaaagcacattcactgtgtatcaatcccagtccagtctttccagagaagactctaaacacctgctgtactgcacctgggcctatgccaatttctatcactcaccgtcactccagggagacagaacacacagagaatacgttacataggcaggttcattactaacagataagcagcgagtgacaacagaagcctacatttcaacgtgagccagtccctcaaggctcagaaaagctgctcgggacatatggagtcacctcatttgcagtgtatctgggggaagccagaaaatagcccagcctgggttttgtaccctgaagccacaggaagcactcagctaaagcactgcatgacgtcctcctccaggaagaacaggaagacagcacaggctgttctgagacgttcctcctgatctcaggacgttgctgtcttagtccatttttgttgctataaaagaacacttgagcctgggttacttcttttttttttttttttttttttgtatagtgcttctgatgagcttttttttaaaatttttattattattatactttaagttttagggtacatgtgcacaatgtgcaggttagttacatatgtatacatgtgccatgctggtgtgctgcacccatcaactcgtcatttagcattaggtatatctcctaatgctatccctcccccctccccccaccccacaacagtccccagagtgtgatgttccccttcctgtgtccatgtgttctcattgttcaattcccacctataagtgagaacatgcggtgtttggatttttgtccttgtgatagtctactgagaatgatgatttccaatttcatccatgtccctgcaaaggacatgaactcatcattttttatggctgcatagtattccatggtgtatatgtgccacattttcttcatccagtctatcattgttggacatttgggttggttccaagtctttgctattgtgaatagtgccacaataaacatacgtgtccatgtgtctttatagcagcatgatttatagtcctttgggtttatacccagtaatgggatggctgggtcaaatggtatttcaagctctagatccctgagga

SEQ ID NO: 233 - DNA, 1871 bp, Homo sapiens
  cDNA KIR3DL1-001
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 234 - DNA, 1800 bp, Homo sapiens
  cDNA KIR3DL1-003
gcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 235 - DNA, 1663 bp, Homo sapiens
  cDNA KIR3DL1-201
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctact

SEQ ID NO: 236 - DNA, 1564 bp, Homo sapiens
  cDNA KIR3DL1-002
ccggcagcaccatgtcgctcatggtcgtcagcatggcgtgtgttgggttgttcttggtccagagggccggtccacacatgggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 237 - DNA, 12058 bp, Homo sapiens
  Coding Sequence of the KIR3DL3 Gene
gtctgcaccggcagcaccatgtcgctcatggtcgtcagcatggcgtgtgttggtgagtcctggaagggaatcgagggagggagcgctggggtggagatctgggcctggagtggagatctgggcctggagtggagatatgggcctggagtggagatataggcctggagtggagatatgggcctggggtggagatatgggcctggagtggagatatgggcctggaactgtagatatgggcctgaagtagagatatgggcctggagtagagatatgggcctggaactgtagatatgggcctggagtggagatattggcttggagtgcagatatggacctggaattgagatacgggcctggaggtggagatatgggcctagagtggagatatgggcctggaggtggagatatgggcctggaactgtagatatgggcctggagtagagatacgggcctggagtggagatgttggcttggagtgcagatatgggcctggaatggagacacgggcctggaggtggagatacaggcctggaggtggagatatgggcctggagtgtagatatgggcctggagtagagatataggacggaggtggagatataggcctggagtggagatatgggcctggagtagagatataggacggaggtggagatataggcctggagtggagatatgggcctagaggtggagatatgggcctggagtggagatatgggcctggaggtgatgtacagatggatcatccatcatgatctttctttccagggttcttcttgctggaggggccctggccacatgtgggtgagtccttcccccaaaccttaggttgtcatctccccacataagatgatgctcctgaaacgggaggcaggcgacacagggggttgactgatgggctgaccatgggaagccatgtgggaatctctcatgaactaggaaaaggaagccaggggaagcttcgccacagttctgtcctagccctccccggcctttctttcccttggctgagtctgtggggacccagggggagactgaagtgctcaaaggagtggtgtgcagggaggaagtggtgtcaccggcagaggaagggagagaagcagtgcaaggaacaacaggcctctgaggacaagagcataactcacaccctccagcgtttccatgacggtaggggctgcaatgtggctgctgtcattctacctaagaggtgggggaaccacagtcatgaccctgacattccagatcttctaataggggctcagttgtttattatggttcatgcattagctgatcatgccctccatcctgtgtctaccttgtgttcttttatgtaagtaattttgcagtgttaaaatctagtaagagtcgcttcttcagcacctgctcaaagttctcagctgacacttgctgtagggagacgccatgtctatgcgggatgggtccttcctgtagccctgggcacccaggtgtggtaggagccttagaaacgtggaaatgggagaatcttctgagcacagggagggaggggcggctccacatcctcctctctaaggtggtgcctccttctcccccaggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggtcagaggctttctgtctgggcttctcactgtcccacctcctgaatcccagagcttctggtgggggcgtccatcagggtccaatcatccaggccccgactgtatttggggtaaagggggattcagtacagagaaatagttgctgtggtgggaagaataattgtccccagtgatggctacatggtaatccatgaaccctgtgactatttatgttatagggcaggggactgaagaggaagatggagctcaggttgttgatgagttgaccttgcgatggggagacagcctggactgtcctgctgtgctcagagtaatcacaagggtcctcatgagaggaggaggaagaggaaagtggggttagagcaacgtcgtgggagggagactccatcagccacagcgggctttgaagatgggggaaggccatgagccacaaaggcaggtggcctctaagggctggagaagtcaagggaactgattcttccctgagtctccagaggaaacacagccctgcagatgccttgattttagcccagagagaactgggtccgatttctgttctccagaagtggaagaggtcattgtattctctcctgccccatgtttgtgacaattttctccagcagcaacaggaaaccaacacaggaacccaggtgaagcacaggttaagaaaccaaacaaggagaaggttggctacactgattttagcatgggtgggatactgatgctaccaccaggctcgatccacatagggaggggttgatgctcctggaaccagcaccaggggccaccctatggaagctggggccatggagaaggcacagacatgaaaggagaggctcccaatccccatcaggaacagggacactgatgcctgccttactgatgagttcgtacctcctgccggcctttccaatctgtccaaaagagattgattcaggctgctaagagcctggacatgcagcctgtcatggttcctcttccacccccacataaacaccaggaaagagattagtgggaaacagatacaacagcctaagaggtgacactgagcacagtgggaagggaatcagggctactagagacagagagacagggaagagggagggagacagatggagggacctgcaacaggggttatgggcacaaaagaacacggagacacagacaggaaggagagagatagacaccatggaggggaagcctcacttatttcaggtcccatgaatgggatgagaaagggagacgccttctgaactcacaacctctcttcttaggagtccacagaaaaccttccctcctggcccacccaggtcccctggtgaaatcaggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtgagagaatacagacctgcctctcacccttgctgggagatggagtgaatgatctaggactggaagccccaggtggtcatgaggaagatgagtgtggggttcctatggagagaaagtgacttggtgaggtctgtaccaacaaaggcagagaaacaggagacacaagtacagacctcatgtcataacatagaagccagacacaggggccatacaaggtgttagaaaaagagataaagaggtaaagaagacacagagagacagacatatcccagagagaggtgtccttctatgctgactttgttcagagaccaggcacaggttagaaggttccattctgttttacctctacaaagtgttctctcccaggagaacccaaagagacacatctatctggcctgagttgggccatgtggccccaggctggtggcacctacagatgttgtgtttattcttaaacctctgccttccgtgcagtggagctgtcatcgtcccaggacaccatggccccaggtgagggagcagaacaccaacccctgtatgctgtgagttcctggagtccccatactggattctgaggctcatattcaaatagcaccacatgttataggattactgagaacaaaagcccacagagagacacggagtgaaatcagggaaatcaaaaagcaaagacatgaacacacacacagaatgagccagaagaagggaattgagagactcacagacacataaagagatagaaaaagagggcagagaagtggagcgtatgatggaaggaagcagagaaaagccctaaaatcagagccctgagggaggggcacaaagacagggaaagataaagatgtgaggatggattgcagagactccaaaagggaactagagagactgagaggcagagaaagacaaggagatggagagagacagatgatagatggacagatagatatagatagatgaaagataaaaggtagatgatagataatagagagacaggtgatagacaaatagatgatgaatgactgatagatgatatagatagacaagtagaaagacagacagatgatatataaatagatatagagagatagaaagacagataaacacatgatgatagatggatagatgcatacatacatacattgattgatagatgatagataacagagagataggtcatagatacacagatgatgatagatgatagatacatacatagataaatgatagatcgatcaatagataatagatagaaatatgcagaaagttatgagcaagacagaaagtgagagactcagaattaaagaaagaggaagatcaagtcaaccagtccaaggagggtcagagagaataaaatggtacaaaaaaagaaaacatagctagggatggagaagtgaggtcagagacctagagagacagagaaggtggaaggaggaaatagacatgaagagagatgggggtggagggtgagagagagaaagagagcattaagtcatagagcaggggagtgagttctcagctcaggtgtgaggagagctgtgacaaggaagaacctccctgaggaaaccacctcttcttcttccaggtctatatgggaaaccttctctctcagcccagccgggccccacggttcaggcaggagagaatgtgaccttgtcctgcagctcccggagcttgtttgacatttaccatctatccagggaggcggaggccggtgaacttaggctcactgcagtgctgagggtcaatggaacattccaggccaacttccctctgggccctgtgacccacggagggaactacagatgcttcggctctttccgtgccctgccccatgcgtggtcagacccgagtgacccactgcccgtttctgtcacaggtgagaaaacaccatgcctgtcccatgtcttgtgatcctagagccatagctgaggagcttcctgctgatgatggagagaagcatggacagatgccgagacagaacacacagcatgggtgtaagggcggggtcagggcgcaggatggcagacagggcacctccaaaccctcctgtatggcctgcaaggatgcccttgatcagggttccaggcacccaggcagatggagaaagaggtcagaacagacccagaggagggagactgggctctgcctggggagatcagaggttctctcagcccctcaaccttacccacttcccagaagcccatcctggcctgtcacccacagagagatgtcatcaccagcaacgcctacacccttttctttttgtttgaagaaatatttattgaggtgaaatatacctatgtaatttaccacctttaccatttttaagtgtgaagtctactgttcataaatacatttataggctgggcacggtggctcacggttgtaatcccaacactttgagaggccaaggcaggtggatcatttgagatcaggggctcaagaccaccctggccaacatggggaaaatccatctgtactaaaaatacaaaataataattataatgataataattagccgagcatggtggcacatgcctgtagtcccagctacttggtagggttgggcaggagttgcacttaattgcaggaggcggaggttgcagtgagctgagatcatgccactgcactgcagcctgggcaacagagagagacactctctcaaaattaattaattaattaattagtattcttttttttttaccctccacccttcccttcctggcctctggtagccaccattctactctctacctttgtgagatccaccttttagctcctgcatatgagtgagaaatggaaatacttgtaatgacctccagttccattcatgtggctgtaaatgacaggatgttactctttctatggatgagttgtccctattgtgtgtgtgtaccacattctctccatccattcacccactgatgggcaggtaggttgatccacatcttggctactgtgaacactgctggaacagtcatgggagtgcagatgtcacttcgatacgctgatgtcctttcctttgggtttacacccagtcatggaattgctagatcctctggaagtgtctttttacattttgttttatggtttttgtttttgtttttgttttttttagactgtttcactcttgttgcccaggctggagtgcagtggcgccatctgggctcactgcaacctccacctccaggattcaagagattccccagcctcagcctcccaagtagctgggttactggctcccaccaccacactcggctaatttttatatttttagtagagacagagtttcgctatattggccaggctgctcttcaactcctgacctcaagtgacctacccacctcggcctcccaatgtgctgggattacaggcatgaaccactgtgcccgacctcattttattttttgaggaacttccatactcttctcctctgtaatggctgtactaatttacattcgtatcagcagtgtaccagatgcaaccctggttgactcagcagagcaagagacgtgcagtaagagagaatttagcttatttatgcacacgacacttccactcactcactcgttcagccaatgccccatgctcaggctgtgcagtgtggaatcttttcctattgttgccataacaaatttccacaagcttcgtggatgaaaacatgtttttcttaattatctcacagtgctgtaactcagaagtatgaactgcatttcactgggctgatatcaaagggacagtaaggctggatttctttttaaggttccaagcaagaatctgctccttaacgtttcccagctcctagaggctcccacgttcctgggcccctggtccccttcctccttcctccttcctcaaagcccacaaaggctggtcacgtctcacatggcatcattcagactcttcttctttacccacacctttttctctgaatcctgctctgccttcttcctcatcttttaaggactttgggattctattggggtcaccaagataatccatctcaatctccctaaaatcatccagcgtaccctctttttaagttcagctgattagcaaccgtaatgccatctgcaatcttcattcctcctttcctgtaaaataacatattcacaagctatggaggctaagacagggacattttgggggtggggcagcattctcctgccttccacaaatggtaaacaggatgcatttggcctctgctcttgggacgctgatattgcagatgggtaaatgcgagggcagagaatgaatgcacaagggtaccaataaatgaatgatccattgggaagcatctgtgcaccaaatctggggttttttgtgtgtgtgtgtgttttttgttttctttttttttttgagtagagtctctctctgttccacaggctggagtgcagtagcacaatctcagctcattgcaacctctgcctcctgggttcatgcaattctcctgcctcagcctaccgagtagctgggattacagctgtgcgccaccacactcggctaatttttttggtatatttttttagtagaaatgaggtttcaccatgttgtgcaggctgtctcaaactcccaatctcaagtgatcccaccgccttagcgtccctaagtgcaaagattacaggcgagagctactgcgcccagccaggatttaaaataagtaatagataatgctgagtatataatttcaggtgacagagaaggtctcactgatcagataatatttgtgaccttaatggaaaaaatggattcaacccttggaagattggcggaaggattttccacactgagctctcagccgtgaaggcacaaaggtggaaacattcttagttcaaggaagaggctctgcctcaaatgctgggaatgagatggggagaatgacaagacaactgtagagagatggagagcacactgggtacacaggaaactaaggaggaacaaggagcatgtttttgatactcacagcccttggattcaactcagagctaactaggaatccctacctgattaacagtgaccgacatgaaaataagggaggcccaggtgcgtaactggaatctaggagaccgtggaaaaggcaattcccgccccactggtgaaacgtagggttgatttacacactaaatgaatgaaagatggatataagctatgcttgtgaggtagaatcatttgcagggagggcttgctgggtttgatttttcctagtagtttaatccttgtttcattaatttctttctgagatgtgttttttttctacatctaaatcaatacctggcagaggagcgatagacacatgaggggtggtgcaaatgaagggacctagtataatataatatacaagactgtggatgggggctcacacctgtaacccaacactttgggaggccaaggcgggtagatcacttaagggtaggagtttgagaccagcctggccaacatggtgaaaccccgtctgtactaaaaatacaaaaattagcctggtgcattggcacctgcctgtaatcccagcgactggggaggctgaagcagaagaatggcttcaaccctggaggcagaggttgaactgagatcgcatcactgcactccagcctgacacagggggactctgtctcaaaaaataaaaataaaacatacataattatgacacacagaaattacaaaggcaactggataccaaccatcatttttctatttctctgtgtttaattctttgaccctttatcttatccattaaacaatcaggttaaacctcttccttatttggctttctgtgagcttgggatcatatggaaaatgtgaaagcctcctgaacccaccagcacaggtcctggaatagagaacgtgctctgttcatggcataaaacttgccccttcacccaaatcccccaattcatctctacttccaatcacctatggagatacagatagatcatggggaggtaaacactaatactctttggagtgagctcagatcttggactcagagaccagtgccagcactagcccctggtcacatttcgtactaactcacagaaggacaggctgtattgaaacaataaacgacggagagggcggtccttccccgtgcttctcgggtggaatagcagcctaatatatgtctcagcagatcacaaaaagtagcatgttgttcctgggctacatcattatttcatggctgtttgatttaagtcagttctacttcactttttttatcttgatttcattttttctttcttttcttggagaatgtaatttttttgagtcaagagggttgtggtggtagaaactgtaaagcacattcgctgtgtatcaatcccaatccagtcttcccagagaagattctaaacacctcctggaatgcacctgggcctataccaattcctatcactcaccgtcactccagggagacagaacacacagagaacacattacacaggcaggttcattactaacagataagcagcgagtgacaacagaaacctacatttcaatgtgagccagtccctcaaggctcagaaaagctgctcgagacatgtggagtcaccccatatgcagtgtatctgggggaaatcaaaaagcagcccagcctgggttttgtaccctggagccacaggaagcactcagctaaagcactgcatgacgtcctcctccaggaagaacaggaagacagcccaggctgttctgggatgttcctcctgatctcaggacgttgctgtcttagtccatttttgttgctctaaaggaacacttgagcctgggtaacttctaaagacaagaaatgtgtttgcctcacagttctgcaggctgtactggaagcatggcaccagcatctatttcttgtgacggcctcaggctgctcccactctggcagaagggaaggagggtctgtctgtgcagagaccacagagatcacacggcaagagagggaccaagggggagggggagcgatggagcttccaagctcttttaacaaccagttctccaggaactaatagagggggaacttgctaaccccgtctccttggaacagcattgatctgttcatgatggatccacctccatgacccaaacaactcccaagaggcccaacctcccactctgggggttacatttcaatgtgaggtttgaaggggtcaaacatctaaactaaagcagttgtatcctcagcacgttctatggttactacaactgagaaagcaggaggaagctaggtctcccgccatctgggtgcttgtcctaaagagacgttgtatgtggttacctgtcaatcaagaaatgtgagacaattcatatagaggaactgctatgattagcttcttattggtgtcttgtcttcctccaggtaactccagaaacctgcacgttctgattgggacctcagtggtcatcatcccctttgctatcctcctcttctttctccttcatcgctggtgtgccaacaaaaagagtaagtctcacgaagcagaagccagagagctcagggccatgtggggaagcaggatgggagcactcaggtgtgtgttcctcacagactggatggtccctggcccaaggcaggagccacagaggcaggactttctagagagagcaccagactccctgcctctgccttcagctcacagaccattgcctgattctgaaccgtatcctcacatcccctgcagccactcacatccaggagaaggttccatgacaggcagaaagtgggacacagaatcaataggatgggaactcagagctatacatgggatggatccttgagctcagagagatagaatgtctgagtctgctgttggcaactgagggacctcaggcacctatggcctccccctgtatgttggtatctgcttatgaaatgaggacccagaagtgccctccgagctgttttgacgacttccgtcttctacagatgctgttgtaatggaccaagagcctgcagggaacagaacagtgaacagggaggtaggtgctcctccgcccagcctcgtggctagtcttattcccaaagagtcctggaaaatgtgagcaccctccctcactcagcatttccctccctccaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 238 - DNA, 5753 bp, Homo sapiens
  1st Promoter of KIR3DL3
atatatacgtgcatatgtacgtatattcataaatgacaaacaggacagaaaaatcagtgacatcaattttgttccttagaagaaacaggaaaattgaccccaaaaaactttccaggccacatttggtcatgatggaaatattttggcacttcctggttaagctcaacaccaacttgcacccaaaaccaataatttcattcctaggtaaatatgtctaattaattcagcatatgtatgcaagggatcacacagaaacacgattatcaaggcccgagttataaaagagaaaatccggaaacaacacaaatgtccatgataaaaagagtggataattacatgttgataaagttatgtatggactattaaactgcaatccaaaagaataaaatagaactataaaattcaatatgtatatggtgtcatagaaacacaaatgtgagaaaaagaaagaaaaatacaaaatttatattttttaaaatttgaaacaactatatatgtgagtgcttagggtgtgtgtgtgtgtgtgtgtgtataaccatatgtatataaacgcacacatacgcacacatatagaatgtcccggccaggcatggtggctcacacctgtaatctcagcactttgggaggctgaagtagacagatcacttgaggttaggagttcaagaccagcctggccaacatggagaaacctcctctctactaaaagtacaaaaattaggtgggcgtgatggtgggtgcctgtaaatccagctacttaggaggctgaggcacgagaattgcgtgaacctgggaggtggaggctgcaatgagccgaggtctcaccactgcattccaaactgggtgacgaagtgagattgcgtctcaaaaaaaaaaaaagttctaaaagttgtgacttgggtgtggcagattgtgacatactgccagctgctagaaatgctggggcaggaggattgcttgaactctgaagtcaaagaacagcctggggaaaatagcacatgaagaagagtttgaatctcagataaaaacaacaaaaatacatcaaaagtctttaatgtaagccaagcattcagtcatctcctgtatgagagattggatctgagacgtgttttgagttggttatagtgaaggatgcaaggtgtcaattctagttggaacaatttccaggaagccatgttccgctcttgaccaaacagccactgggcctcatgcaaggtagaaatagcctgcatacgtcatcctcccatgatgtggtcagcatgtaaactgcatgagcccctcacaacatcctgtgtgctgctgaactgagctggggcgcagccgcctgtctgcaccggcagcaccatgtcgctcatggtcgtcagcatggcgtgtgttggtgagtcctggaagggaatcgagggagggagcgctggggtggagatctgggcctggagtggagatctgggcctggagtggagatatgggcctggagtggagatataggcctggagtggagatatgggcctggggtggagatatgggcctggagtggagatatgggcctggaactgtagatatgggcctgaagtagagatatgggcctggagtagagatatgggcctggaactgtagatatgggcctggagtggagatattggcttggagtgcagatatggacctggaattgagatacgggcctggaggtggagatatgggcctagagtggagatatgggcctggaggtggagatatgggcctggaactgtagatatgggcctggagtagagatacgggcctggagtggagatgttggcttggagtgcagatatgggcctggaatggagacacgggcctggaggtggagatacaggcctggaggtggagatatgggcctggagtgtagatatgggcctggagtagagatataggacggaggtggagatataggcctggagtggagatatgggcctggagtagagatataggacggaggtggagatataggcctggagtggagatatgggcctagaggtggagatatgggcctggagtggagatatgggcctggaggtgatgtacagatggatcatccatcatgatctttctttccagggttcttcttgctggaggggccctggccacatgtgggtgagtccttcccccaaaccttaggttgtcatctccccacataagatgatgctcctgaaacgggaggcaggcgacacagggggttgactgatgggctgaccatgggaagccatgtgggaatctctcatgaactaggaaaaggaagccaggggaagcttcgccacagttctgtcctagccctccccggcctttctttcccttggctgagtctgtggggacccagggggagactgaagtgctcaaaggagtggtgtgcagggaggaagtggtgtcaccggcagaggaagggagagaagcagtgcaaggaacaacaggcctctgaggacaagagcataactcacaccctccagcgtttccatgacggtaggggctgcaatgtggctgctgtcattctacctaagaggtgggggaaccacagtcatgaccctgacattccagatcttctaataggggctcagttgtttattatggttcatgcattagctgatcatgccctccatcctgtgtctaccttgtgttcttttatgtaagtaattttgcagtgttaaaatctagtaagagtcgcttcttcagcacctgctcaaagttctcagctgacacttgctgtagggagacgccatgtctatgcgggatgggtccttcctgtagccctgggcacccaggtgtggtaggagccttagaaacgtggaaatgggagaatcttctgagcacagggagggaggggcggctccacatcctcctctctaaggtggtgcctccttctcccccaggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggtcagaggctttctgtctgggcttctcactgtcccacctcctgaatcccagagcttctggtgggggcgtccatcagggtccaatcatccaggccccgactgtatttggggtaaagggggattcagtacagagaaatagttgctgtggtgggaagaataattgtccccagtgatggctacatggtaatccatgaaccctgtgactatttatgttatagggcaggggactgaagaggaagatggagctcaggttgttgatgagttgaccttgcgatggggagacagcctggactgtcctgctgtgctcagagtaatcacaagggtcctcatgagaggaggaggaagaggaaagtggggttagagcaacgtcgtgggagggagactccatcagccacagcgggctttgaagatgggggaaggccatgagccacaaaggcaggtggcctctaagggctggagaagtcaagggaactgattcttccctgagtctccagaggaaacacagccctgcagatgccttgattttagcccagagagaactgggtccgatttctgttctccagaagtggaagaggtcattgtattctctcctgccccatgtttgtgacaattttctccagcagcaacaggaaaccaacacaggaacccaggtgaagcacaggttaagaaaccaaacaaggagaaggttggctacactgattttagcatgggtgggatactgatgctaccaccaggctcgatccacatagggaggggttgatgctcctggaaccagcaccaggggccaccctatggaagctggggccatggagaaggcacagacatgaaaggagaggctcccaatccccatcaggaacagggacactgatgcctgccttactgatgagttcgtacctcctgccggcctttccaatctgtccaaaagagattgattcaggctgctaagagcctggacatgcagcctgtcatggttcctcttccacccccacataaacaccaggaaagagattagtgggaaacagatacaacagcctaagaggtgacactgagcacagtgggaagggaatcagggctactagagacagagagacagggaagagggagggagacagatggagggacctgcaacaggggttatgggcacaaaagaacacggagacacagacaggaaggagagagatagacaccatggaggggaagcctcacttatttcaggtcccatgaatgggatgagaaagggagacgccttctgaactcacaacctctcttcttaggagtccacagaaaaccttccctcctggcccacccaggtcccctggtgaaatcaggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtgagagaatacagacctgcctctcacccttgctgggagatggagtgaatgatctaggactggaagccccaggtggtcatgaggaagatgagtgtggggttcctatggagagaaagtgacttggtgaggtctgtaccaacaaaggcagagaaacaggagacacaagtacagacctcatgtcataacatagaagccagacacaggggccatacaaggtgttagaaaaagagataaagaggtaaagaagacacagagagacagacatatcccagagagaggtgtccttctatgctgactttgttcagagaccaggcacaggttagaaggttccattctgttttacctctacaaagtgttctctcccaggagaacccaaagagacacatctatctggcctgagttgggccatgtggccccaggctggtggcacctacagatgttgtgtttattcttaaacctctgccttccgtgcagtggagctgtcatcgtcccaggacaccatggccccaggtgagggagcagaacaccaacccctgtatgctgtgagttcctggagtccccatactggattctgaggctcatattcaaatagcaccacatgttataggattactgagaacaaaagcccacagagagacacggagtgaaatcagggaaatcaaaaagcaaagacatgaacacacacacagaatgagccagaagaagggaattgagagactcacagacacataaagagatagaaaaagagggcagagaagtggagcgtatgatggaaggaagcagagaaaagccctaaaatcagagccctgagggaggggcacaaagacagggaaagataaagatgtgaggatggattgcagagactccaaaagggaactagagagactgagaggcagagaaagacaaggagatggagagagacagatgatagatggacagatagatatagatagatgaaagataaaaggtagatgatagataatagagagacaggtgat

SEQ ID NO: 239 - DNA, 1758 bp, Homo sapiens
  1st Enhancer of KIR3DL3
aaaaagagtggataattacatgttgataaagttatgtatggactattaaactgcaatccaaaagaataaaatagaactataaaattcaatatgtatatggtgtcatagaaacacaaatgtgagaaaaagaaagaaaaatacaaaatttatattttttaaaatttgaaacaactatatatgtgagtgcttagggtgtgtgtgtgtgtgtgtgtgtataaccatatgtatataaacgcacacatacgcacacatatagaatgtcccggccaggcatggtggctcacacctgtaatctcagcactttgggaggctgaagtagacagatcacttgaggttaggagttcaagaccagcctggccaacatggagaaacctcctctctactaaaagtacaaaaattaggtgggcgtgatggtgggtgcctgtaaatccagctacttaggaggctgaggcacgagaattgcgtgaacctgggaggtggaggctgcaatgagccgaggtctcaccactgcattccaaactgggtgacgaagtgagattgcgtctcaaaaaaaaaaaaagttctaaaagttgtgacttgggtgtggcagattgtgacatactgccagctgctagaaatgctggggcaggaggattgcttgaactctgaagtcaaagaacagcctggggaaaatagcacatgaagaagagtttgaatctcagataaaaacaacaaaaatacatcaaaagtctttaatgtaagccaagcattcagtcatctcctgtatgagagattggatctgagacgtgttttgagttggttatagtgaaggatgcaaggtgtcaattctagttggaacaatttccaggaagccatgttccgctcttgaccaaacagccactgggcctcatgcaaggtagaaatagcctgcatacgtcatcctcccatgatgtggtcagcatgtaaactgcatgagcccctcacaacatcctgtgtgctgctgaactgagctggggcgcagccgcctgtctgcaccggcagcaccatgtcgctcatggtcgtcagcatggcgtgtgttggtgagtcctggaagggaatcgagggagggagcgctggggtggagatctgggcctggagtggagatctgggcctggagtggagatatgggcctggagtggagatataggcctggagtggagatatgggcctggggtggagatatgggcctggagtggagatatgggcctggaactgtagatatgggcctgaagtagagatatgggcctggagtagagatatgggcctggaactgtagatatgggcctggagtggagatattggcttggagtgcagatatggacctggaattgagatacgggcctggaggtggagatatgggcctagagtggagatatgggcctggaggtggagatatgggcctggaactgtagatatgggcctggagtagagatacgggcctggagtggagatgttggcttggagtgcagatatgggcctggaatggagacacgggcctggaggtggagatacaggcctggaggtggagatatgggcctggagtgtagatatgggcctggagtagagatataggacggaggtggagatataggcctggagtggagatatgggcctggagtagagatataggacggaggtggagatataggcctggagtggagatatgggcctagaggtggagatatgggcctggagtggagatatgggcctggaggtgatgtacagatggatcatccatca

SEQ ID NO: 240 - DNA, 9586 bp, Homo sapiens
  2nd Enhancer of KIR3DL3
tcaatgtgaggtttgaaggggtcaaacatctaaactaaagcagttgtatcctcagcacgttctatggttactacaactgagaaagcaggaggaagctaggtctcccgccatctgggtgcttgtcctaaagagacgttgtatgtggttacctgtcaatcaagaaatgtgagacaattcatatagaggaactgctatgattagcttcttattggtgtcttgtcttcctccaggtaactccagaaacctgcacgttctgattgggacctcagtggtcatcatcccctttgctatcctcctcttctttctccttcatcgctggtgtgccaacaaaaagagtaagtctcacgaagcagaagccagagagctcagggccatgtggggaagcaggatgggagcactcaggtgtgtgttcctcacagactggatggtccctggcccaaggcaggagccacagaggcaggactttctagagagagcaccagactccctgcctctgccttcagctcacagaccattgcctgattctgaaccgtatcctcacatcccctgcagccactcacatccaggagaaggttccatgacaggcagaaagtgggacacagaatcaataggatgggaactcagagctatacatgggatggatccttgagctcagagagatagaatgtctgagtctgctgttggcaactgagggacctcaggcacctatggcctccccctgtatgttggtatctgcttatgaaatgaggacccagaagtgccctccgagctgttttgacgacttccgtcttctacagatgctgttgtaatggaccaagagcctgcagggaacagaacagtgaacagggaggtaggtgctcctccgcccagcctcgtggctagtcttattcccaaagagtcctggaaaatgtgagcaccctccctcactcagcatttccctccctccaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcagagtatctttcagccttctgtcagcagtaaaacttataaattttttttataatttcaatgtagttttctattcttcaagtaaacatgtctgccctcatggtttcttcaatgggactcttttcttgcctaaggcttccggtgttatcattaccacgtccacataaccccatctgttctccgctgggttctcagccctggactctgagcttctggaagcatggtggagcctgaattgtctctgagactccaatttccatccaaagatgcagcacataggaggttccaaggatggtgaatcagatgaacaagtgatattcttactctctgcagatctggaaagctggcagagtcattccacgatgaaacatttgtagagtcataggccttgttagtctcatctccacagggacacgtatcaacacatcatctttcatactactataaatagacagtcactcctccatatctctggggtttacacatgtttattgaatcagcaataaatcaaaaatattttgagaaaaaaaatccccgaagtttcaaaaagcaaaaaactatgttgaatcgacacaaattgagtggcgtgtaggctgtgtcaggaattataagtaatcaagagatgatttcatgtatacaggaggatgtgcatgggttctatgcaattgctatgctattttttttttttttttgagacagtctcactctctcacccaggctggagtgcagtggcgtgatctcaactcactgcaacctccgccttccaggttcaagcgattctcttccctcagcctccccagtagcctcccctaggattacaggcacgtgccaccatgcacagataaatttttttgtgtgtatatttttagtagagatggggtttcagaatgttggaccagctggtcttgaactcctgaccttgtgatctacccagctcagcctcccaaagtgctgggattacaggcgtgagccacggtgcccagcttcactatgccatttcatgcaaggggcttgagcatctgcagattttggtatctgaatggggatcctggaaccaatcacccaggtatagtgaaggaccatggtatataatttttatttgtcaatcttaaaaataaagcataaaaaatttacaacaacaagataaaaaataagaagtgtttttatagtgtgaggataagtttagatttattttttcctacgtgtaaccctatggtcctgtgttatttgttgagaaaatattctattccaccttaaactacatggcagcctttgtcaactataaagggactgtgtatccacagatgtattttagacacagttttctgtccagtggttctctgtatcccctctcatgaggatgctgcattttatataaacttatagaaccccttaaaatttggtaacctgagtcctctgatttgttattataggttatttagtttgctttttttttttttcttgagacagactcttcctctgtcacccaagctggagttcagtggcttgagctcagctcactgcaacctccgtctcccaggttcaagctattctgatgcctctggtttagtagtagaaactcaagcaggaaaattagaatggcttcttgtcacaattactctgataatgttaataatacctgttagacattttgcacattacatatgaagaagagtttgaatctcagataaaaacaaaaatacatcaaaaatctttaatgtaagcacagaattcaatcatctcgtgtatgagaggttggatctgagacgtcttttgagtctggtcgtagtgaaggacgcaaggtgtcaattctagtgagaacaatttccaggaagccatgttccgctcttgagcgagcacccactgggcctcatgcaaggtagaaagagcctgcgtacgtcaccctcccatgatgtggtcaacatgtaaactgcatgggcagggcgccaaataacatcctgtgcgctgctgagctgagctggggcgcggccgcctgtctgcacagacagcaccatgtcgctcatggtcgtcagcatggtgtgtgttggtgagtcctggaagggcatcgagggagggagtgcggggatggagatcggggcccagagttggagatataggcctggaagtggagttatgggcctagagatggagtgatgggcctagaagtggagatctgggcctggagtggagatctgggcctggagtggagatatgggcctggaggttgagatatgggcctgcagtagagatatgggcttgtagtggagacatgggcctggagatggagatatgggcctggagatggagatatgggcctgcagtagagataggggcctggagtggagatatgggcctggagtggagatatgggcctggagtggagatatgggcctggaggtggagatatgggcctggaggtggagatatgggcctggagtggagatatgggtctggaggtggagatacgggcctgcagtagagatatgggcctggagtggagatatgggccaggagtggagttatgggcctagaggtggatatctgggcctggagtggagatatgggcctaggaaggagatatgggcctgggtgtggagatatgggactggagaggtgatatgggcctggagtggagatatgggcttagggtggagatctgggcctggggcggagatatgggactggattggagataggggcctagggtggagatctgagcctggattggcgatatgggcctagggtggaaatatcagcctggagtggagatatgggcttggggtggggatatgggcctggaaactgggtctctgcacagccgacagccctgttcttgggtgcaggtaggcactgagggtgagtttaacttcagcccaggaagggcctggctgccaagactcacagcccagtgggggcagcaagggaggcctggtttgcctgcagatggatggtccatcatgatctttctttccagggttcttcttgctgcagggggcctggccacatgagggtgagtccttctccaaaccttcgggtgtcatctccccacataagaggattttcctgaaacaggagggaagtcctgtcggggagtctctcataaactaggaagagaggaccctggggtgctcagcccacatttctgacctcgcctccctggcctctcaaccccttggcagagtcaagttctgtggggaccagggttagactggggtgctcaaagctggggtgtgtggttgggaagtggtaggaacagcagatcctctgaggacaaaggtgttactcacacacttcagcgtttccatgatggtaggggctgcagtgtggctgctgtcattctaccagaagaggtgggaaaccacagccatggccctgacattccaaatcctctgatgggggctcagttgtttattttcgttcaggcatccgctgatatccattcacaaaggacatgccctccacctcatgtctaccctgtgttgttttatgtgagtaatcttacagtattaaaatctagtaggagtctctttactcagcacttgctcaaagttctcagctgaggcttttgttgtagggagacaccatgtctttgcgggatgggtccttccttcagccctgggcaccaaggtgtgatagtagccatagaaacgtggaaagcgaggagaatcttctgagcacagggagggaagggcagttccacatcctcctctctaaggcggcgcctccttctccccaaggtggtcaggacaagcccttgctgtctgcctggcccagccttgtggtgcctctaggacatgtcattcttcggtgtcactcttatcttgggtttaacaacttcagtctgtaaaaggaaggtggggtgcctgtccctgagctctacaacagaatattctggaacagccttttcatgggccctgtgacccccgcacacacagggacatacagatgtcggggttcacacacacactcccccagtgggtggtcagcacccagcaaccccctggtgatcgtggtcataggtcagagggctcctgtcttggattctccttgtcccacctcctgaatcccagagcttctgttgggcatgtccttgagggtcccatcacgcaggccctgactgtatttgtggtaaagggggattgaatacagggaaatgggtgctgtggtgggaagaataattgtccccagtgatgactacattctaatccctggagtctgtgactatttatgttataggggaagggactgaaggggaagatggagctcatggggagacagcctggactgtcccactgggctcagtgtaatcacaagggtgcacatgaaaggaggaggaagaggggagtggggattagagcagtccagtggaagtcttcaccagctttgaaggtggaggaaggccaagatccatgaatgcaggtggcctatagaggctggaaaagtcaaggaactgattctccagagtctccagagggaacaaagccctgcagatgccttgattttagcccaggaaaaatagggtccaatttctgtctccagtactggaaggtgtcagtgtggtctctcctgctgccatgcttctgataattttctacagcagcaacaggaaaccaacactggaacccaggtcaaggacaagttaagaaacaacccaaggaaagccaggcatggtggcaggtgcatgtaatcctagcgactcaggaggctgagggcaggagaatcacttgaacccaggagacagaggttgcagtgagcctagaccacaccacttcactccagcctgggtgaaggagtgagactctgtctccataattaattaattaattaaagaaaccaaacaaggagaaggttggctaccctgagatcagcaagggtgggatgatgatgccaccaccaggctccatccacatagggaggggttgatactcctccaaccagcaccaggagccagcctatggaagctggcaccatggagaaggcacaggcatggcaagagtggctcccagtccccaccaggaacagggtgtgtggacactggtgcctgccttattcatcagttcataccttctgccaaggattgcaattcatccaaaagagattgaaccaggctgataagagcctggatgtgcagcctatcctggttcctctttcacccccacataaacagcaggaaatacattagtgtgaaatagatacaacaccccaagagatgaggctcagcccagtgggaagggaatcagaggctactagagacagagggacagagaagagggagggagacagatggaaggacctgcaccaggagttaagggcacagaaaagaacatgaagacacagagaggaaggagagagacagacaccagcaaggggaagcctcactcattctaggtgccatggatgggatgataaagagagacaccttctaaactcacaacctctcttcctaggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtgagagtgtccggacattctcattgtcattgggatgcagagtgaatgatccacgacttggaacccccaggtagttgtaaggaagatgagcttggtattcttatggagagagactgacttgctgaggtttgtaccaacagagacagagaaacaggagacacaagtacagaccaggtgtcataacagaggacagacacaggggccatacagggagttagaaaagacagaaagagttaaaagagacagacagacagacatgtcccagagagaggtgtccctccatgctgactttgctcacagacctggcacaggttagaagtttcatttctgttttacctccacaaagtgttctctaccaggagaacccaaggacacccatatttatgacctgagttgggccctgtggcctcaggccttgtggcacctacaggccatgtttattctgacacctctgccttccatgtaatggagagtaatcgtcccaggatatcatggccccagaacaccaacccctgtatgctgtgtgaacttgtggtctccagactggattctgtggctcacattccaaataaccccacatatgaaaggatcactgagaggcacagagaaaaatcaggaacaccaaaaagcaaagacataaacacacagagaatgagccagaggaaggagattgagagactcacagacacataaagagagagaaaagagggcagaggagtggtgagaatgatggcagggagcagagaaaagcactaaaattagagtcctgagagagaggcacaaggacatagaaacatggagatgtggggatgaattgcagagattccaaagagaactagagagaccgagaggcagagcaagacagatgatagatggatagatatagatagatgataaataggtagatgatagataataggttaaagatacatagatgatgattgattgattcattaatagataatacatagagatgatgatgatgaagacagataatacgtacagatagagaggcagacagaaatcatagagagagagatgatacatacatataaataacagatgattgatggatagatagacaagtgatagatacatagatgatatatagatatagatgacaggtagagaatttgtagataggcaccgaatagataaatagatagatcgacagataatagatagaaatatgcagaaagttatgaacaggacacaacgtgagaaacttagaatttaaaaaagtaacatcaagtcaaccaatccaaggagagtcagagagaataaaagaatccaaaaagggaaaacatatctagaggtggggaagcgaggtcagagacctagagagacagagaaggtggaagaaggaaatagacatgaagagagatggggtggagggtgagagagagagagagagagagcattaggtcatagagcaggggagtgagttctcagctcaggtgaagggagctgtgacaaggaagatcctccgtaaggaaaatgcctcttctcctccaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggtgaggaaaccccatatctgtctcatgtcctatgatcctagagccttagctgaggagcttcctgctgatgatggagagaagcatggacagatgcagagagaagacgaagcttgggtgtgagggagggatcagggcacaggatggcagacagggcacctccaaaccctcctacacggcctgcatgaaggcccgcggccagggctccaggcacacaggcagatggagaaaacggtcaggagagacccagaggagagagactgggctcagtttgggaagatcagaggttccctcagcccctcaacattacccatttcccagaagcccatcctggcctctcacccacacagggatgtcatcaccagcaacccctacaccctttacttttgtttgaagaaatatttattgaggataaatatacctatatagcttaccacctttaacattttttttttttttgaggcagagtctagctctgtcccctatgctggagtgcagtggcacaatctcagctcactgcaac

SEQ ID NO: 241 - DNA, 3469 bp, Homo sapiens
  cDNA CD276-002
ccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 242 - DNA, 2738 bp, Homo sapiens
  cDNA CD276-201
ccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgt

SEQ ID NO: 243 - DNA, 951 bp, Homo sapiens
  cDNA CD276-001
atgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctga

SEQ ID NO: 244 - DNA, 2690 bp, Homo sapiens
  cDNA CD276-003
cgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctc

SEQ ID NO: 245 - DNA, 2439 bp, Homo sapiens
  cDNA CD276-007
cgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctgg

SEQ ID NO: 246 - DNA, 649 bp, Homo sapiens
  cDNA CD276-014
attcgggccgggcctcgctgcggcggcgactgagccaggctgggccgcgtccctgagtcccagagtcggcgcggcgcgtcttgcagtatcgcccagactggagtacagtggcgcgatttccactcactacaacctccgcctcctgggttcaagcaattctcctgcctcagcctcctgagtagctggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgca

SEQ ID NO: 247 - DNA, 640 bp, Homo sapiens
  cDNA CD276-012
gcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctccta

SEQ ID NO: 248 - DNA, 628 bp, Homo sapiens
  cDNA CD276-015
gggcgaaggtgtgggcgactggtgcacttccacaggcagccgtgggcagcatgaggggtcagattccgggaaggacaggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgct

SEQ ID NO: 249 - DNA, 621 bp, Homo sapiens
  cDNA CD276-016
tttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgc

SEQ ID NO: 250 - DNA, 550 bp, Homo sapiens
  cDNA CD276-018
ctttctgggctgtggtgccagcatggtgtggaggaagaacccaagactggggttggacagcaggattccagccctgttctgccgccagtcgatgaccagcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgc

SEQ ID NO: 251 - DNA, 547 bp, Homo sapiens
  cDNA CD276-021
attcgggccgggcctcgctgcggcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcgg

SEQ ID NO: 252 - DNA, 507 bp, Homo sapiens
  cDNA CD276-017
ctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctcctt

SEQ ID NO: 253 - DNA, 505 bp, Homo sapiens
  cDNA CD276-020
agtcccagagtcggcgcggcgcggccccacctcttaatactgttacagtggcaattaaatttcaacatgagtcttaaagcacccatgtcatctaggaagaagaaactgtatttgcagcaacactgtgaggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctga

SEQ ID NO: 254 - DNA, 6438 bp, Homo sapiens
  cDNA NCR3LG1-001
aaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccggctgtgtctccgtcaactctttacgcaacagaggtctccccctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaagatatgtaacaaatcatcttcagcctatactcctctcaagtgcattctgaaacactggaactcctttgacactcagactctgaagaaagagcacctcatattcttttgcactcgggcatggccgtcttaccagctgcaggatggggaggcttggcctcctgagggaagtgttaatattaatactattcaacaactagatgttttctgcagacaggagggcaaatggtccgaggttccttatgtgcaagccttctttgccttgcgagacaacccagatctttgtcagtgttgtagaattgaccctgctctcctaacagttacatcaggcaagtccatagatgataattccacaaagtctgagaaacaaacccctagggaacactcggatgcagttccggatgccccaatccttcctgtctcccctatctgggaacctcctccagccacaacatcaacaactccagttctatcctcccaacccccaactttactgttacccctacagtaaatgcctgatggacctggtgccactagggtccaagttcccttttcattacaggaccttgggcaaataagaggggacctgggcaagttctctgatgacctgatagatatatagaggctttccaaaacctaactcaggtgtttgaccttacttggggtgatgttatgttgctcttaaactcttaactactacagagaaacaggtagccctgcaggcagcagaaaaattcagagatgaacaacatgtcttctatagccactcaataaggaaagaaggtgagaaacaaccagcattcacatacccaataggaagcgaggcagtgccccttgaacaacataattcggaccccagtggtaccttagatgagtggcaaagaaaacattttcaaatgtgcttattagagggcctacagaggaccagagccaagcctcttaattaccccaaactctccatgatagatcaaaaactagatgaaaatccctcagcctttttggaaaggctgagagaggctgtagtgaaacacacttccttgtctcctgttaggtatgtttatacctcacataaataattcaattgagggacagctaattttgaaagacaagtttattactcagacagcccctgatatcagaaggaagctagagaaacaggccatgggattagatagcaccttacaaaacctcctgaaggtagccacctcggtcttttataatagggaccaggaggaggcccaggggaaggagaggaaacacaagaaaaaggcagagactctggtggccactttgtataaaacccagtatccccaaggtacacctgctagttgctaccaatgtggcaaactagggcacttcaaaagggactgcccaggcagcaagaagaagccacctcaaccctgtccagtatacaatggggaccactggaaggcagactgtcctgggaagcataggtcactgagtccagagccagtctcacaaatggtccagcaggactgatgggtcctggggctcaactccctggctccagtggctcagactgctgttactacccgggagcaccaggtgattctggagttcgaagggaggaaggtagacttctttctggacactggagccaggcttctgttttcctctccaattcaggccttcgttcctcccatagcacaaccatgatgggcatctcaggaaagactttaacttgatatttttctcaacctattagttgcagtcagagggacctactgtttacacaggcctttttagtcatgcctgaaagtcccactcctttattagatagagatattccagcacgtatgggggccaccatccttatggctccaggacaaactccgcctccccttagtggaaaccagtattaacccagaggtttgggcaactcagggaagaagtggccggactataaccactataccagtctggatccacctcaaggatcccactttttttcctaaccagagacaataccctctgaagccagaaagtagaaaagggctagacgccagcattgataacctaaaggcacaaggcctccttaggccttgcagtagcccttgaaacaccccaatattaggggtgcaaaaatccaatggggaagggagactagttcaggacctctgccttattcatgaggctgtgattacgattcatccagtagatcccagtccctatactttgctaactcaaatatccaagggaactaaatggttcacagttctgggcctaaaggatgcctttttctgtatacctttataccctgactcccaatacttgtttacctttgaagacccctccaatcaaaccacccagttaacctggactgtactgcctcagggatttagagatagcccccacctatttgggcaagtattgtcaagagatctcttcgaattcttccattctcaggttaaagttttacaatatgtagatgacattctcctctgtgccccaactgaggaagtttcttgagacggcactgaggctctccttaatttcctagctggaaagggatataaggcttcaaaatctaaggctcagctctatcagactttggtaaagtacctaggtctggtcttgtcagaagggaacaagagcactaggcgaggagaggattaatcccatttcctcccttcctctccccagaaccctcaagcagctgagggatgcttgggcattacaggtttttgtaggttatagatacccaggtatgataaaataggttgccctttatatcaccttataaaagaaattcaagtggctaaaactcacttcctgacctgggaacctgaaggtcaaaaggccattaatcagttaaaacaagccttgcttaaagcaccagcccccagtctttctgtagggaagtcctttaatctttatgtatcataaaggaaaggaatgaccctgggagttttaattcaagttcaaggcccagctcaacagccagtaggttacttaagtagagagcttgacttggaggctaaaggatggccagcttgcctctgagcagttacagtagtggccctgctagtcccagaggccaccaagttaaccctggggaataacctgtttatgcctcacataaataatgtggcaggcttgctgtcctctaaagcgagtctctggctaacagacagctgcctcctcaagtatcagactttgctgctagaggaatctgcagtccagttaaaaacctgaccttgcctgatcccagacactttcctcccagaggaaactggagaaactgaacataattgtgaacagactgtagtacaacctatgccgctagggaggatctcaaagaaattcccctagaaaatccagactggacccactttatggatgggagctcttttgtaggacagggagtctgaaaagtgggatatgcagtagtcaccctaaataacattgaaaatgtgcctctctcaccaggcacacacactcaatcagttgagctgatccctctcacaagagcacttgaactaagcaaaggaaagacagctaacatttatactgactccaagtgtacctttctagttctccttgcccatgctgccatctgaaaggaaaggcacttcctcaccgctaatgggtcttgcattaaataccatcaagacatcaacaggctattatcctcagtgttcctcccatgagaattagtggtcagacattgcagagggcatcagaagcgggtagatgaaatagcgaaaggaaacaggctagcagaccaaagagctaagtcagcagtaagaaggccccaaggtcccaaaacacttgaggcccctctgatttgggagggctacataagggaaataaagcctcagtattcccctacagagatagaatgggccacctctcgaggtatacttttcaaccctcaggatggttacaatcagaagattgcaaagtacgcttgccagcctccagccaatggaagattcttaaaatcctccactgagcctttcacttaggaaagcataagacatcagtgcatccaaagattgttctcaggagaaaatctactaaaaatggtcaaataggttgttaatactcgtgaaaccctcttaaaaataatccctttaacagatgacttcttccccaccacaatcaaaggatgggaagttactcaggggaggactggcagatagacttcacccatatgcccaaaataaatggcattcaatgtcttttggtgtgggtgcataccttcattaactgggtagaggcattcccatgcccaacagaaaaggcctctgaggtggtgagaatactaattagttaaataattcctcactttgggctccctaagtacttccaaaacaacaatggtccctcatttaaagaagcctctacccagtagggccgagtctgctaggactttttattgggtttggtaatacgtcacaccctttagcctctactgtgtcagccatgtcccatttatacaagacaaattgctgggtctgtcctgagcggtttgctcagttcagtaacactaaggaacctcttgatgacttggtatttactgtcttagcattccctttgttagctttacctttagccattaaagacttgtcaggcataaatggaacatggtatgggaacactttcaactgagtaactaactcctcccaggaaagcatttcctccctggtgccagaaaacactttccccaaagataagcctcacaccctcaggctaggaaaagttggccgggtaatagcaaatgcctcctcctgttttaaaagcagaggaaaaggaccatacctgggagatctcaaatattataacaccatacttgtaattgctgaaagctcggaagtttggagaaaaagacataagaaggatgatctaagaaaattggaagccatatggaggggaggctttcagaattcagcgtctcctcctggttgaaagtcctgctgggaatggcaggctctgggtaaccaccctgacacatggcactataatgtaaaaaacaacacataggccttcccagacatgcaccctcatgggattccagaccccctgtatgatgcttagtagtagtggcctacaaatctgtgggtgaacagaacaggagacttctggactgacagcccctgtcacaagggggcattatctgagatattggccagggcatatcgtgtccctggtcttttgaaactccatttgtcggccaggtgtggtggcttacgactgtaatcccagcactttgggaggctgaggcaggtagatgatgaggtcaggagttcaagactagcctggacaatatggtgaaaccccgtctgtactaataatacaaaaaaaaaaaaaaaaaaa

SEQ ID NO: 255 - DNA, 2429 bp, Homo sapiens
  cDNA NCR3LG1-002
cctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaagatatgtaacaaatcatcttcagcctatactcctctcaagtgcattctgaaacactggaactcctttgacactcagactctgaagaaagagcacctcatattcttttgcactcgggcatggccgtcttaccagctgcaggatggggaggcttggcctcctgagggaagtgttaatattaatactattcaacaactagatgttttctgcagacaggagggcaaatggtccgaggttccttatgtgcaagccttctttgccttgcgagacaacccagatctttgtcagtgttgtagaattgaccctgctctcctaacagttacatcaggcaagtccatagatgataattccacaaagtctgagaaacaaacccctagggaacactcggatgcagttccggatgccccaatccttcctgtctcccctatctgggaacctcctccagccacaacatcaacaactccagttctatcctcccaacccccaactttactgttacccctacagtaaatgcctgatggacctggtgccactagggtccaagttcccttttcattacaggaccttgggcaaataagaggggacctgggcaagttctctgatgacctgatagatatatagaggctttccaaaacctaactcaggtgtttgaccttacttggggtgatgttatgttgctcttaaactcttaactactacagagaaacaggtagccctgcaggcagcagaaaaattcagagatgaacaacatgtcttctatagccactcaataaggaaagaaggtgagaaacaaccagcattcacatacccaataggaagcgaggcagtgccccttgaacaacataattcggaccccagtggtaccttagatgagtggcaaagaaaacattttcaaatgtgcttattagagggcctacagaggaccagagccaagcctcttaattaccccaaactctccatgatagatcaaaaactagatgaaaatccctcagcctttttggaaaggctgagagaggctgtagtgaaacacacttccttgtctcctgttaggtatgtttatacctcacataaataattcaattgagggacagctaattttgaaagacaagtttattactcagacagcccctgatatcagaaggaagctagagaaacaggccatgggattagatagcaccttacaaaacctcctgaaggtagccacctcggtcttttataatagggaccaggaggaggcccaggggaaggagaggaaacacaagaaaaaggcagagactctggtggccactttgtataaaacccagtatccccaaggtacacctgctagttgctaccaatgtggcaaactagggcacttcaaaagggactgcccaggcagcaagaagaagccacctcaaccctgtccagtatacaatggggaccactggaaggcagactgtcctgggaagcataggtcactgagtccagagccagcttctgttttcctctccaattcaggccttc

SEQ ID NO: 256 - DNA, 2708 bp, Homo sapiens
  cDNA CD86-001
ggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattca

SEQ ID NO: 257 - DNA, 1405 bp, Homo sapiens
  cDNA CD86-002
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaata

SEQ ID NO: 258 - DNA, 891 bp, Homo sapiens
  cDNA CD86-005
cactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctataggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcct

SEQ ID NO: 259 - DNA, 2634 bp, Homo sapiens
  cDNA CD86-201
ccctttctgtatttgagttctaccgtcagtcctggcattatttctctctctacaaggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctataggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattcattt

SEQ ID NO: 260 - DNA, 1604 bp, Homo sapiens
  cDNA CD86-003
attgccgaggaaggcttgcacagggtgaaagctttgcttctctgctgctgtaacagggactagcacagacacacggatgagtggggtcatttccagatattaggtcacagcagaagcagccaaaatggatccccagtggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctag

SEQ ID NO: 261 - DNA, 1572 bp, Homo sapiens
  cDNA CD86-004
attgccgaggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctctt

SEQ ID NO: 262 - DNA, 567 bp, Homo sapiens
  cDNA CD86-007
gtatttgagttctaccgtcagtcctggcattatttctctctctacaaggagccttaggagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaag

SEQ ID NO: 263 - DNA, 483 bp, Homo sapiens
  cDNA CD86-006
agttcccctttctgtatttgagttctaccgtcagtcctggcattatttctctctctacaaggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtaagaacctttcagctttgttaagtcctggaatcctactgtctcctgatgagtctgaccacagcaagcccaggcctgagacttggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatactta

SEQ ID NO: 264 - DNA, 689 bp, Homo sapiens
  cDNA CD86-008
aggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtaagaacctttcagctttgttaagtcctggaatcctactgtctcctgatgagtctgaccacagcaagcccaggcctgagacttggtgggttttactcactttctactgagcattgtacaagaccacatgcaaaaaagactttcctggagaagaaggaagtgttatgattgagagcagctgatggcaggcagctgggatggagctctcccccccgtgtgcttcttcctcctctgcagtctcacatcagtgagcctagatgctcagagtagggtagcctggcccatcccatggggatgggggaaggctgctgcactgaggcccctgagacttgactcttttgttccacacatattctcttctggtcttctctgaccctgtttctgtctttctcaggctcctaggaaacaactgacagaattccaaaagtctcccttcattcggagcactggctttcacgtccctgacttccctaccctctctcactcccttccctacagcccatgcacatacc

SEQ ID NO: 265 - DNA, 1691 bp, Homo sapiens
  cDNA KIR3DL3-001
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcaggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcggaggccggtgaacttaggctcactgcagtgctgagggtcaatggaacattccaggccaacttccctctgggccctgtgacccacggagggaactacagatgcttcggctctttccgtgccctgccccatgcgtggtcagacccgagtgacccactgcccgtttctgtcacaggtaactccagaaacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 266 - DNA, 4576 bp, Homo sapiens
  1st Enhancer of TIGIT
gttaaatttatctgataggattctgcattctttccctgtgttatcttgaattccattgagtttcctcaaaacagctattttaagttctctgtgacatatctctgcctctccataattggtcactggtgtcttatttagttcatttggtgaggtcattttcctggatggtcttgatgcttgtggatgttcagtagtgcctgggcattgaaagtcagatatttattgtagtctttgcagtctaggtttgtttgcatctttctttcttgggaaggctttccaggtattcaaagggacttgggtattgtgatccacattttggtcactgcagctgtatctgcattaggaggcaccccaagcccagtaatgctgtggctcttgcagactcagaggtactgccttggtggtcttggataagatccagaagaattatctggattatcaggcagagactcttgttcttttcccttactttctcctggacaaatgaaatctctctctctctgtgctgagcttcttggagctggggatggggtgacacaagtgcccctctggacaccaccactggtgctgctctgtgtcagacctgaagccagcacagcactgcatcttgctcaaggcccatgttaactactgtctggctactgcgtgtgttcactcaaggctctacagtcagcagctagtgaatccagctaggcttgtgtttttcctttcaaagcagcaagtttctcctggtcccagattcagagatgccatttgggatctagggcctggagttggaaaccttaggaatccatctagcgctctattctacttcagctgagctggcatccaagctgcaagccaaattccttcccactcttccttcccctttctgcaagcagaggagtctgttcccatggcccccatggccctaggcccacagcaagtactagcactgatgttcattcaaggcccaagggtccttcagtcagtttgtggtgaatgttgccagccctgagactctcccttcggggcagtgggctcccttctggctcaagcctggtctagaaatgctttccaagaggcaaggcctggaagtggtgactctaagagcctgcttgttgctctaaccgactgtggctgagcttgtacctaagctgcaagacaaagtcccttttactctgtcctcttcttttctgaagcagaaagattctcttcccataggcaccacagctgcaaatttgctgagtcacacctgaagccagcatgacacagagtctcacccaaggcccacagtgagtactgcctgggtactgctactgattattcagggcccaagggctctttattcagcaggtgatgaatcttgtcaggactgggcccttcccttcaaggcagctggttctcttctggcacaggatgtgtctagaaatgtcatccagaagctggggcctggaagcacagtgccctatcctactgtggttgagttggcatccaagttgcaagccaaagtctcctttactcttccctctcctgtcctcatgtagaggggaagaagtctctactgcagctgtgtgccgtgctgcctggggttgggggaggaatggcacaagcactcccttggccacctcagctggtatcttactaggtcatgtgcccccaaatccactgactctgagtccagcacagcacaaagagctgctcaggaattttagtacttgtggcctagactgcctttcaagtttatttaagaccccagaggacttttgcccacaatggcgaggcatgccagaactcagtttcaaactattcggatggacgattcccctctggctagaactggtctaaatgctccctctgtgggcaccagttgagttttccccagtgttgctttccactgtgacaggcagcactgaattccaatgcaaagtctcacaatctctgcactccttccacaaagcaccaagattctctctgcatcatgtgatggctgttgggggatggtgaaggggtgccattggcaattcaagacttctttcctatcctcttcagtgcgtctttcagaaatatgaagttaaaaaaaggtacttcgactgcttatctgatttttggttctatgaaagtggtgtttgtgtggatagttgttgaatttggtgttcctgtaggaaggacactggtggaggcttctgttcagccatcttgctctgccccctcctcctggtactctttctctttcagctgcgcttgaacacctcctttcttttcattttgactttttactacaagttttgaaaagtagaagaaagagaattatacccatattactatcacctaaacttaacaattaacttttttgccatattttctccatttttaagagtttaaaaattatagacatttcacaccaaaacacttcagtagaaatctctaaaaaaattgtcctacataaccacaatattattatcacactgtattagttttctaggggttgccataacaaaataccacagactgggtggcttaaacaacaaaaatttgttttctcacagctctggagactggaagttcaagatcaaggtgttggcaggtttggtttcttcaaggaggcctttctctttggcttcagaggatcaactttttgctttgtccttatatggtttcctctccatctttgtgtctctgtgtccaagttttctctactataaagactctagtcagtgtggtttaggactcaccctaaagacttcattttactgtaatcaccttcttggaggctctatcttgaaatatagtcacattctgacatactgggagttaagatttcaacatttgaattttggagagataaaactcagtccataacacacacacttaataaaactaacagtagtttactaatataatttaatactgaatctctagttgcttttttacaattgtccaccaaatctctttgttcaaactaagagccaaacaagaaccataaattgcatttggctgtcacgtcttctaaatttatttaaatatagaataatccggagggggaggagccaagatggctgaataggaacagctccggtctacagctcccagcctgagcgacgcagaagacgggtgatttctgcatttccatctgaggtaccgggttcatctcactagggagtgctagacagtgggcgcaggtcagtgggtgcgcgcatcgtgcgcgagccgaagcagggcgaggtattgcctcactcgggaagcgcaaggggtcagggagttccctttcctagtcaaagaaaggggtgacggacggcacctggaaaattgggtcactcccacccgaatactgcgcttttccgatgggcttaaaaaacggcgcaccacgagattatatcccgcacctggctcggagggtcctaccccacagagtctcgctgattgctagcacagcagtctgagatcaaactgcaaggcagcagcgaggcttggggaggggcgcccgccattgcccaggcttgcttaggtaaacaaagcagctgggaagctgggtggagcccaccacagctcaaggaggcctgcgtgcctctgtaggctccacttctgggggcagggcacagacaaacaaaaagacagcagtaacctctgcagacttaaatgtccctgtctgacagctttgaagagagcaggtgttctcccagtacgcagctggagatctgagaacgggcagactgcctcctcaagtgggtccctgacccctgacccccgagcagcctaactgggaggcaccctccagcaggggcacactgacacctcacactgcagggtactccaacagacctgcagctgagggtcctgtctgttagaaggaaaactaacaaacagaaaggacatccacaccaaaaacccatctgtacatcaccatcatcaaagaccaaaagtacataaaaccacaaagatggggaaaaaacagaacagaaaaactggaaactctaaaaatcagagcgcctctcctcctccaaaggaacgcagctcctcaccagcaacagaacaaagctggatggagaatgactttgacgagctgagagaagaagtcttcaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagcaaagtttagagaaaaaagaataaaaagaaatgaacaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacattcagattcaggaaatacagagaacgccacaaagatactcctcgagaagagcaactccaagacacataattgtcagat

SEQ ID NO: 267 - DNA, 15736 bp, Homo sapiens
  2nd Enhancer of TIGIT
agtcctggagtccgaaagccagggagcctggtgtcctgatgtccaaggacaggatgagaagagtgtgtcccaactccaaagagagaaagtacaattttgcctctcttctgttttgggaaaggcaggcctccaggtgagtggatggtgcttggctacatttagagtgtatcttacctactcacttcactcagactgacatgccaatctcctttggaaacaccctcacagacacacccaaaatgggctttactagctctctcagctcccttaatccagttaagatgatacctaaaattagctatgacaggcacaacagcattcactacagaccttgagagcccatagactgtgttatttaggagcatgttctttggaatcagacagtcctaggtttgggtcccaactcaaccacttgagtagctgtaccacctaactttgatgaacctcagttttctcatctgtaaaatgccgataattatggcattgccttcataaggtcatgagaaaacttcagtcaaataataattaatgtaaggcacttagcatttttcctagcatgtaagctggaaaggtgagtgggaccatcacaagggatgtttttgggatcatcacaagggatgttttggggatcatcacagtttcttatgaggaatgtagtgaaattatggattttcttcttgggcaaaattttctatacaatttacaaatcccctgaaatccagctgtgcatctcaggttaagcaccctcctatatacagtggagccattgaagagttttaggcagaaatatggactgacacaacttttgtttttgaaaatcactctgctggcgaccatgtggagttggactagaagtaagagggagtccagagacagtgaggatgaagcccaggtgtgagagaagacatggatatagagatggaaaagagggagtagatttcagaactgcctaggattaaaattggatgaagttttacagataaattgagttgaacattagcctccagatttctgctcagctggtgccataaaccagggcagtgaatataggggcaggagtggtttgttggggcaggaatgtgatggtgtcgtttgagacaatttgagtctgagcttgccgtgggtcatcaggtgatgatgcccagtggacaggtggacacctgcatctggagctcagggcagaagcctgggctagtttagatagagatttgggcatcttcagaggacagatggtggttgtagatgtaagaaagtagatgctcatgaaatcactcagagagcatgtttagcgtgagagaaagcagagagcagaaccctggggaaccccacggtttggggagctgatgtgcaaagagaaaaggggcaggcctggctgaagacgaaggtgggggttcaaaggaggagaagaaaatcaggagagagtgatgccaaaggatccagagaaagagaacatttcagaaagtaagaggtcgacagagtcaagtgcagtaaacagtacaagaaaatagagaatggaaagctgcctcactaagcttagtgaacaggaagtaacaaggtgtgtggcacgtggtatatgtagtaagtgcagtttccatggactagttagcatttaaatctagctgtaacgcggttgagaaattaagggctaaggaattggtgttggtaagaacataagtttgctggtgtgcatgtgtgtaagaaaggaagagagagatgtcatattggggattaactgttgaataacatccccacatactcactttgtagtttgtttgtttttagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacattagtttcatgcttctttttatctttttaacgtggctactggaaagtctaaaattgcatatgtggctctcatatttctatgtgactgtgctgctctagtagctaaacccaagccaaactgatacccagggagggtgtctatctatgtctattggtctccatttctttttctttcaaaatagtgtttgaggaagattttcctgcttatgatgtcttttgggaaatatgtagggaagcatcacagagaagattgaggaaggggaacactcagtgctgacaggaagcgatgccaggcttttctgggtcccctcgtggattccctaacaggaggagcgaatagacaaatctatgaatgagcattcaaggaggaatacattactgattccctgaccacattctaagcctgggcgtacaagtctgatctataatcctgagaattatactaaagaaacgtgagaaactttgagtcatggagctttgagatagatggtcttcatgagtgaacaggacctcactatgcaattttatttcctgccttttccccttttcatttctcaccactgtgagccccagaaatgagtcgtcatacactcaggttcattcagattccatcagtgctgagctggacaggcagggaggctgggtgtgaggtccaccaatgacagcattctggtgggcacacctcaccccacagagagggggcaatgggcagtgtggctgtcatttgtggggtgtgagttttgtttagtctcctgattctttcaggtgctgcttcatagctgtaactggtagtttcccacacttactccaagtcacacctgtcaagaggtacaggggagctttttgtgtggcaagagcctgagctttctggaagtcacaacgatatactcaatgtttgaggtaatttatttgcataaggtagtgtaggacaatgctatccaaagaactttctgcaattatggaaatgctctatgtctgtcccatccagtatggtagccattagctgcatgtggctgttgagcacttgaaatttggctaatgtgacaaagaaactgaattttaaattttatttcattgtaattaacaaatttaaatgtaaatagcaacatgtgactggtggctagtatattggacattccaattctagtaattgccttgcatatagagaaaacacagacagctgtgtttataggacattggatggctcgccagttgttatgcatttgaaatggctatcaccaggaagaaacttgaaggttctcctctactctcctatatccatcctctgatcgagacaaaccatgaggtcaaagcaggctgtacatttatttatttcaggttttttcaaaaaaaaaaatctgaggcagctaagtggtccagttcatgtaaatagggccaaaattgtcaagaaatttgcaactcataggggttatgcagaaatagactgtcatcacaggacttaccatagactatattcattctgacttcatgtaggctgtgaagagcaccttctctgggactaaaactctgatggacttcacagagatcaaaaaagaagtaatcatggagtgtagtggacagggaatttagaaacttggtccaagtgctgagctctgcaattagtttcacgactttggataagccacttaacctatcaaagactcataaatatttcctcatttataaaatggtaatattactatctttctaagattcttaagaagatgaggcaggaacgtggctgactgctttgtgagctgcaagatgctgggttaatattattgtgttctgccccaggaacacgtgcaccaggtaatgctaatgatgccacagaagttttcatggaggcaacaaaactggcttggagcaactgaggtatctgaaattatctatcaatcaatgttcttaaaaactgagatataaggaaagctaagagttgcagatacagccttggggtccacaagttctctgcaagcgtttaaacattgtgtgttttaagtgaaatgataatcttcaaagaagtcatctatatctggatgttgatagccttcttaaaacagagtgttgtcattggttttagcctctatgtttgtgtttatacatataaacttgattataatcaagtttatttaaaggcacagaagcttaatttataaatgattcatttactcccagatgggtggagaagtggaagactttgcagtattgaactaacaggaaagtgaagcgataattgctttactttgcacactgtagtgtagggatgttgtattcagaagggtgtgtgcagtacacttaactttgtgagccatgacttagattcaggaaagcatcattctatgcactcattgttattgtagacattactaattttatagttttacttgtacttaattagtaacttgtagttttataattctacaagggatataagcatagtaagttcacttgtcgttgtgtttgagcctatttaagaatgtctataataaaataattatgcatattatgaatttattactagatattataataagaataattattttattattatcgcctcccattgaggaggtctgtgaaactattttttttccttcatatgggcatacacacattactcaagtttgagaataatggtatggtataaatattattggatttcagaaaacctgacctcaggcactagtttattgttttttattggaaaaacacatatttctgaacctgtgtttttataaattagtgcaatcatagctacatcacaatatttacagtataactgtgaagatgaaggatattaaggagaaactttgtaaactgtgaagtaccatatgagtagcgtatgtgtcatttacaattattacagcctgtatataaatcgcaccacaatgtttttaacaggtacagaagaaaacttaagagtgtgtggatagtgcaaagagagatccaagactttgggtgaagctggctggcattgttaagaagatgttggttcacagaaatgatatagagacaaattatgcatcatgaaaatattttcttcctctttatacttctagactatcaatcaggttgacttagaagttcagcaattgagttgcaagaagtaaatatttaaattcacagtggtaatgttgaaatctcaggaatttattgacatcctttcagtctagaggtctcttgatgactctccccatcccaagctcatgcctggatatttttgtgctcctcacactggtggaaatgtctgtccacactcagcttctccaactcaaagcttagtgttcttgcgagtccccaaactagaccgcttattctttggaccctttcttgactcactctagccattatcaacttcctgttagtttagaaactcccttggcattgagagtctgaatggcacaatctagctcttgattttatacaaacctctcttcatgtctagttgttagattttaagccttctcatggctgaaataatttcctctcttttattcatacattgcacagtgctgactgaaatacagaagacattgtgaatttaatttgtgttgacttcaccaaggacaaacaagatataagttttcttcaccatattagcactttctgtaagaatgatgagatcagagagctctttatggccagggtcactataacaaagaatctatgggccaaataggagtcccttatgagtctccaaagtcattaaagaggggcatgttttgtgccatgaactttccttttttgcatatggagctgagaaacccaaaagttaaaaaggagactcagtgatagattcatggataacagagatgggtggaaacaagaataggtgggcatagtgttataatatgggattgattatttccacagcaggcagactgtgatttgcatgtggaaaaggaaaaaatgtgaatcaatttgtagagcaataagtgatccttgtcatttttgaggtttgaatatgtataagacaatacaccaatttgctttatatttcctcaaagtgacttcgacatcaccaatcctgtctgtagttcctacttcttgtattgagaagactaatatactcagagtttttctggccttgtaggtagagtcctcagtttggataaataatctcagattagacatagaatacaatgtgtgaaagaatgtggagaactgcctaaaacagaaactacagtataaagaagacacaataggaaaccaagagaagagtttttttttttttaattattccttcatattcaaacttcacaaacagtgtgaacttgtacaatacctcggaaagtgaaacttacaaaaaaagtgctggtaacatttaaaaaaaaaacaacaaaaaccccaaaaaaacaaacatcattcttagcaacatcaattactcttccacacaaaacagaaaccttgtaaaatttattttcgtatttttaaggcgtaatacttccgtataaagtatatgcaagagataaaacttcacagtattccaaaatgtcacaataataataataatataatagtataatgaagcgctacagttaatttttctttttttgaatgttttttttcctgtttaaataacaaatacaagtcacaggtaaatatacgtgagaaaaatacgaggctaatattaaatggcaggtaaggatactgtcactgtaagaaaaaactggcaggatgtgtgtatttagtctatattttaaagcacttgatagaaaaggcgtatgcaaggtttttccaaacaatttttctgtttgtttgtttgataactgacaacaatttaagagtataatgagaaaaaaaaaggaacaaactccctctcaaaactattgacctgctcatcccaaaccatgtatatgttgatggatggatgtgtgtttttgtggatatatggatttataccgtgcacagagtgatacaagcagtgttccatgcccacctgcaaagattggagggtataacactgcagtcattcagcccaggttcctcttaggaaattaacctttcaatttaaagctctctttccttgcctctccctctttccaaactcttcctcaattcccaggtctttgttctgaaaagacaatctggttagaaaagttgccctccactcataattcactgggaaatggaaactgcataaacagtgacacacagacactggaaacaccacttgaatgaatgaatgaatggatatgtatgtgtgtgtgcatgtgtgtatgttttaggtcacataaacatacagtgtgtgcgtgggtgtgtgtattttaggtctaaacatacagtgtgtgtgtgtgtgtgtgtgtgtgtgtgtgtgtgtgtacacagtagcaattgcaaaaaagggaccatattcctttccatactaagatacaatgtgataagaaacatttctgtgcagggaaaaaggtttcttcgaatcttatcacaacactgcggcgggaaaatcaggaaatgggttcacctttcagcagtcaccacagtaaacttcattgagaacatacatgcccagatatctcttctgtgcacatgtatatgttaacagctagccattcagccaacaggtaacagaaagacagcagatagcaaacacatcaataaggtgctcaaagaaaaaagtggcacccacttctcaaatggatggccacgttaaggtgcttcaaaaaaggttttttgtttttttgttttttttttcagtttttatttcaaacattaagagagtactgattttcacatggtagttctgagtcaggccaaaggttttgaggtttctgacatctttcactgaaaagggctttcactgtagtagttttgttcagtttgttgtgggtgacgagtttaaaaatgtttttcatagccagaaactgaaatcaaatcaacatgactaaaagaaataactgatgaaatggtatatagaacattactgcattcgcatcggatcaagatggtttcgcccatttttcctttttcactaacactgttcctttttttccttgttacaatccattctttatgaacatacagaaatgaccaaagtcactgcaagtagctgtttttattttttgtgatctgttgcaagagtccaaccttgtttcctctgctgctgtttgtgtagcatctggttttgtaatgagcatctggatttgtaatgagcatctgattttgttatgtgcatgtgtgtatatatgcacatatacacacctatacatgtataatatatacactatatatatgtggatacatataggaagtgtgtatacatttatacataatatagtgtatatcgtttcaactggagataaactgaactgggttcagacactagcacatgcttaactttcccctgctccctctgtatattttaaacagtctggagctttaatttattttttaaagtgcattttcaatgcagaaaaactgtaatccactgattccttggaaaacatttttgatgagaaaaatctgacagttctcagccccaagcaagagaaacctgggtttggtcatgctgggggctgacgtggcagtgccaggctcgtgcctgagtgattaatggacattctggactccgggcaccttagcagcagcagcagcacctttatgagaaggtagagatagaaaaggaagaaggaaggaaagctcagatgaggaagaatgaagtattgtgtttacgtatcaaaattgctaactttgactataatggacttgtgcagttcctgttggcctcggctaagagatgccatctagtcccttctccaccaactgacaccaaactccccatggcccctgcatgctcaaacatcacccatatgtccccacgcctaaggctgacttctgtgtcagcttcttgtgggtatgtgagtgccagcatcaagtaggaataaggcaccagagaaatcaaaatgttacaaaaagatgcaaaccccatttcaaagagcctctcccattgctccattaaaatattgcatgtgataccattcgtttgtgtgtacctaaagtgtgtcaaatacagtctctgaaaggaactcgaggcccttcagcaccagagatcttcaggaatgcatcttttttctaaacacacccacaccacccccaaccccccatgcccaccccacaccaaaagcaaaagcaccaaattgggagaacaaggctgcttgccattgctcacctcatttttgaaaaaatcagagaagtctatgaaatacaatgttcaggaaatgctctgaaatcaaacggatttaggctgtcatgtacatggttactcaatgctttaaatgtccaaagagtgtcatgaaggggttgaaatgtttgtgttcaatgtttagggggaatgtgttaaacaaaagttacttctcaaacgatgcccaaatcttccactaacacatcaacctcccctatcactttttaaaaaaattgtaaagaggaagaggttcatctaactataaaaggaaaagatgaaggcacgtgatattattcggtcccacaatccttaagaaaaacggtattttgcaagtttgtgtgtgtgtgtgctcgcatacatgaaacgcgagtccaaggggccattggggcagtagtccaagggaagctggaaaaggggaacaagagagagtttttagacagaagaaaggaaaaaggaagaaatagaggcctctcttcagctttctgtcattgacagtctcaagattcggctgctttagagtccagaaaggaatttgtttgtcttggtctggaaagtgccccagttaaatatctccagttcatcatggtacagcttttggtgtttcccttttcccttccctccagccaaatgattttttaaaaaaatcacagtttttaaaaattattttttcaatgttgaaaaaatatggaaaagctattgaacagccttagggcactgcctctccatcttcacagtgagcagatggatggataatccacagagtcaaagaggaggtgggcaagatcccttgtgctcagtggtctcttgccccaccttcctgagggctggggggccttcacaccacccacagccatttccctcctttgggtccctgcccccctgctcccatccatggaatgtgggctgctgagaaaggcagagccaggctagggaacgatgataacagtaacaggagggtctcagaagcagagggtgaaggagacaggaggcgtgctctcctcaggcagtgttagcagtgtgctctcttggcagcctcatctcaggatgggaaagtgtggttgcccactgagagggtgaagtcccactcacattttacttcgtgagacctcaactctcaggctcaccacctttatgcctctctttgcatcaggttggcccccagtccctaagaaggcaatgatttgagatagagaggcagagcccggctgtgtcatacaaaaaagggcaacgcacagcaggatttcagaaacaaatttaactttggttttccaactttttcaaaccataaaaattaaagcagggcttcggtggctttgataatctgacagctgttatatttttctcatttggcaaggctaaggcagggggtagggggaagagaaaaggggtttcccataattggttgaagacacagggtggtaaaatgcttccacacttaaactcacagtccagtgtttttgacatttcataaatagctttttttctctaaaaaaagaataaaacaagaacaatccctttacttactcatctgaaacaaaataaacagcagtgggtacaaacttcttcttgtaacaattacaaaaaacaacaatataatcccaacttttaacacgcatcttgaatcagtaatttttttttaacctcaaaactgcagcatatccttaagggcaaacttttcgattagtttttttctttttttttttttaaataatgtcttcaccaaaaaaacagtcttgtaccaataaaatgcattcaaaaatagaaaatattacacaacaaaaatatgtatccttcctttccaaaaaagattcttcacaaaaaaatgtagaaaaaattccaacaatttttttcctctcctaaacattaaccttcagtctagggcacaattatttattgatttaaatgtctgtttttgcataaaacatggaagatgcaaaacatttactgtattaggattgtgaagttacagccactcccacccctgctctaaaacaaaacaaaaccagaaaaaaaccagcaaacattaaacaaatgatagagtcagttggctaggaaaaataccgctgttcttccctttactgtgcatttgtatgggtaaacgggccagtttggtattggggaatgttgacgaagggagatcaggtttcaagattggattcaagagcttctttagcatatgctgataccaatgagtcactgacagtccccaggttgtacaactatccattgcaaatcctcatgagaagagaaacacatgaggtagcacatgggaagtcagaggactgaagcgtgtccatgtgtgtactgtacacatacatcttgaaaaaccactttctcaagcatatacatatatatatatatataagcatatacatatatatatacacacacacacacaaatttgttacatagccaatttgtttttaaatattttttctcaaaagggagctcaagcataagttaaaaggtgatgtggaaatccagtggtatgaggaaggctggggttatttcctccatactttcttccacatttaacctgtttgggcattaattgcaataatgacaagatctctgctctcagaggaatgctctgttttctccatccccattgaactaccaggttccttttatattttcagcattgtagtttaaactatgtatttttcttacttgatgatattaatctttcatgtgggatgtagtttgtatgtgtattcagtacaaatatatttttttcatagctgttttcccctgttgcttatttgctgtttttttccctcatggttttgctttgttttgtttctgattttttaaacagtgaaatatgtccaattttatttccagtgcattaaacaaattttaaattaaaagaagaaataaacgtttccccccatctttctaaaggaaatgactaacaaaagtacaatacaatagaatcaggcattgccaagaatagcatgatgtgcaacctcaattatatcaaagaaaacaaatagacaaacaagaattatagaacataagtatgaaggagccaagattacataattccaactatggtatgattggcaagcactggttaaaaaacaggtaaggctactcttagatttctaactcaacatagttaaccactgctcttctgtcttttccttcaacttttaatcttttactccctagttctttatatctttaaaatgaacaaatttgtttttatatttttggtctacagtagaattacatattaataatataataaaaagatatttcattaacaggttggtactgcatccatgtggggacaatagaaaaaaagtactcaaatagacatagcaaatggactctattcttataaaaataaccacaaatataaagaaattataatcagggcaacagattaaaatgaaaaggggtatagaaagatatattttagataatataaactcctgacaagctatgccctagaattgcagcctccaaaccttgcccatgatttccacctttccatagcctcacttcaagttcaaatggaaatgaaaacaaaataaagtgaacaggtggttgagccagccaaagcctccaagttatgttaggtggacagtaagaccaggtggacagcatttgagaaactggctggacacaggggagctgctactggtatttatatttaatttggaggaatttccagcccactgataaagagagaaaccaaggaaccaaatgacttttctagtaacatataatatatgagatgaaatataattctgttagagaggacatggtggtgagatgggaaagaaaagagaagagaaacaggcagacttcgggcaccatctccctttgttttctacaatgcattggtttccttctgttgcggagcattctttaggattagctacagaccccaatgtcctctgagtaaatatatgtcagctcagctcctgacatgatatccatgcttattggcctcctggagggctgggtggttctggagggtccctcccctgctatcactgcccactggcccttgccttcaataaagcagagaaggtgtgcaaagtttcaatggcaggggctctttacgttaactatacctaactgatgactaattcacacagatggttccatatggaaacaaaaaataaagagaaagaactggtaagagttgagctcggtagccaactagtgtgaagttttcttccaggaaaaaaagaaggagaaaaagaaatggtatctgtcagaaaatactgcttttggtttcttttaactttgagctgtccttggtttttctctcagtcagttgctccagtttaaaggagagtttagaatctagtgcaaatatcatcaaatcacagcattccagagcaatatcctgtcccttcatcctaag

SEQ ID NO: 268 - DNA, 14447 bp, Homo sapiens
  3rd Enhancer of TIGIT
aacttattcctaagtattctgtacttttttttttttttgctgtgattatagatggaggctgtctttcaaaacactttctgattaattattgctgtgaatatagaaagactgttcatgtgtatgaattttatatcttgttaattttcagaattcttttattgtttatgatattttccatattgattcctttgggttttccacacatatataatcatctatagctagaaatagttttgtctccttatttataattcttatacctctaaatgcttctcttacttaattaaattggctaatatttccagtaagttgttaaccagtcacagtaataatgggtaccctttcctgactttagtaggaatacctctagcatttctccatcaaaacagatgctagtttggggctaattttacatgtgtgtgtgtacaaataatttacacacacacatgtaaaaataatttttttacattgtgtgaaaaaataatttacagattcttctttcactgaatttaaaaacaattggtcaggccaggcactgtggtttaagcctgtaatcccagcactttgggaggctgaggcgggtggagtttgagaccagcctgaccaatatggtgaaaccccatctctactaaacacaaaaaattagctgggcgtggtggtgcatgcctgtacttgggaggctgaggcaggagaatcgcttgaacccgggaggtgggagttgcagtgagccaagactgtgccattgtattccagcctgggcaacaagagagaaactccatcaaataaataaataaataaataggtcatggggattgatttcatcagattgcttatcagaatcaaaggaaatgattataggctttgaaaaatatagaccttatatttattattagtggattttgcaatattgaatcattcttgctaccctggaataaaccctacctggtgattatgtattttgtttaatatattatcggactctgcgtaacaatatttagaattttttcctcaacatatggaagtgagattcaaatctggtgttctttaattgtgtgcaatcttaatcactttaatatcagttttgaattcatatcataaaactaatgaagaaggctttatgttctatgtctgtatattttaagtaacattgaaattatctgctcttcagaagtttgttgtagtctctttgtgaaatcttctaggtatggcattctttttgctggggacaggaggagctcttgatgcttgagggagtcttggaatgatatgttcacgtgtacttctatcccagtcctagttgtcttggatgactgagggctctaggtaagaggaagaaggaaagaagtgtccaggggtagaggctacctttcccaaggaagatggggccgggatggattgatagtataaaggactgagagtaacaatgattctttgcttgaccaaactttgtcagcaaagtttgtcctgaaccttctcctaggcccatccatgcacttccttgtaaaatccattttttagccaagaacaaggataaatcagttttgcaagaacccctatccccctgtatctgatcacccttgatatcttatcaggtttctcatcctccaccatttctcagttcatgtctgatctaccctggcctgtctttagcaagaatcctattaggtcagtttagccagaatcttccttacacgtgatgttccctcttagcacttttccatccactgacccccactctgcttcttggtgataaattcccattgcccatgctgtattcagaattgagcccaatctctcccccactgcaaaatcccattgccttggtctctatacctattgtgatggtcctgaataaaggctgccttacctttaagaagtgtcattgcctaagttgtctaattatacgatagtttaatcccatctagaatagaggaggagaaggagggaagcaatgtgggtgtgtaggagggttgtgaagagaggcggcaggagaggcctaagctgagaggatcagccgcctcttcccaaagatttttcttctgactttgcattccaacctatcctaggggtctctgtcctattttcacagctggaaagaagaaagaaatttcccatagtcggttgaacttcttggcagccttggaggatggaggagatagatcctcagagccacctcacgggagggagttttgacaaacagaagtcagcggtcccactcccaagttctcctcatttgtatttgccagtgtcagccaagtcccatggcttgttaataagcctcagatcacgggcagtcctttcgcgtggagtctgattttctgaggcagctctctccacaagtggctttggaactccatcactcaggccgccccactgtgaggaagcttggctaaggctgtgagacagctgggggtgatgggacacagggcgggcccttcctggtgcctggggcggccaggtccccttgtcccccctgtgtcagggctcccgtgcttcctcgcccttctctcctaacatctaaggcaggaggcagggccttctcgccccccgccataatataacctgccaccaggaggcgctgttctacaggatggagagtggggagcttggaggagagagcacgaccccctgctgctgccgcaggatgttgcccttgattctaggcagagacaggaggcatcagacagctgtgacagccatggagctcccctaccacttctgagccagagggaagactttggagaagcagaagcccaaagacactgctgggagattggtctgtgctctgggagaaccctaggttgtgtttcccgtgtacaagccaccgatcttgtggaaggtaccaccactcccagccccgcttggctgagggctgcgggccacaggttttcaggaccgtgcttgtggttggaggctgtggactcaagtgcggctggcccgggactttcacagggcgcagggcgggctaggggaaggcccagctgtgaactgataagggggttttacagtctaggccagcacttcttcccctttcacgggcaaacgtgacattctttttcagcacctgtactcacccagctgcatcaaggcggaccagacttgtccaactcacagccccaaaagtcagggcagaataaagcacagtggctgattttagcatttttaaaatagaaatgtgagtcagcacctgatggacctcacagatccctgctatgccacgagggctgctgactggccttaaaagctcagggtggcccggggagctctcagagcaggcctgcttctcacagctgagccgctcagtgctgggggctggtgttgagtgggtgggaaccagccaggttccccgtggagtctgtgcaggaggctctggagggtctggggtagattccctggggagagacttctgtcatttgctttcctccaaggcagcctcagggtctagctggcaagtggtcactttcctgcagaaacatgctatcctcctgttctatcagataaggagggcagaatgaagaggttgggtggaaccctggccttggagtctggagactaggattttactcttgacaaagcacattatatagatagggatattgtcctccaattttcctttcacttccttaattaatattgttatcaatactactgttgatgtattgaactcctgccatcttccaggcactgtgctgaacacttcaccaaacactagagaattaaatcctcacaaccctatgaaagaggtactcttattcctatatgcacatggggaaactgagccttcaggaggttgagaaagttttccaaggtcaccaaacaggatgactttggacccagtctgttaatcatccccctctagagcaccattgatcaaaatggacttgaccatattcctctttggactggttacttagcaaaaaacagaaaaattatttaacaattgtttaaaaccacctctaagtttctctggatatctcattatataagagaggtctcacctctttggctcccacccagctcaactatggaaacacaggctgtaaatttttatagcccaaatcctagtgtccaccactttctgtgctctagtcccactagctgctcttggccctgccactcctggctccccggccttagtgagtttgggaaacatccctccagttcaaccttggcaccttcccttggacacacattaggtattatttctccttcagctgaaggctttgtagctattgaaaggcaaggcatctcttgatgtgagccttgaaggacaggttgctttgggtaggcagagagaagctggtaaggcgtatattgtctaagggtctggaggtggggtataaggggtatacaagtcatagagttggggataggcagaacccagagaggggagaaaactggcctgagatagaagaccttgcaagggagaaggagggtaggagcctggatggtgtgaaatgctagaggtgcatggctggaatggagggggtggggcaccaggcttcagatgcttctgggtgcagatgcagattttcaggatgtacaacatggagcatccccaaggcaactgtgttgagagcctgcgaggcaggtgaatgtggatcttctaccccctctcctgactgagttcaccaaggaacaagctttgtaaactatttgagggtaggggctgtgattatttactctcatatcctcagagcctggtgttgaggttggtgctttgtaggcacccagggactttcaaatgaatgaagggagggagggaggaaagaaggatgggtccatagtaggacctggtgatgggctgggagctccaggcaaatgtcaaccaatccctctcctgggtcagctcccaggggctcacccttctttgcatttccagctctcatgaggtcattgtgcacaggaaagctctctcctctaatctcctctgatcctactgcaccagagaaatcaagccagaattcaataaagtctcagtccagataaacaagacaaaagaaataagattcgagtagaagatctccttcaagggaaagttgctgtgtttgtccaagacctttgtcccatccatgtatcatcccccaagtaaacacttcttgttcacctgttcattagatttcaagtgcagtccctggcctgtaagtccctacaatgataagcttctcttatcattgcacattcttcatcaggaggatgccagaggagctcagccaacagttcctcatcagtagcagattcttcagaatcttgggcactacacagatgcccttgagctctttgaataaaggctgatttttagaaaaaacattaagacagaacttaaaaacaatagattgactataatccaaagacgagtgtacctctaaccacaattttcatttatttttaaatgtttccttcatggcctttcttgtggctcaccctatgcagtttgtgtatttgttgacaactttatgtgtttttaatatggtttttgccaaacttggtttttccgagaccgtcttttctcagaggctcagttttaccgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggtaaggcctgaaacccagcagagcagcagggaggaaaaacaaggctaagcttggttggagacttgggtgcttgtgtagggaagactccaagagcatgccacagctgcttgagagaaagaaattgcaacttttagagtcctgtgtactcttatttaagaaaggacaatctctgagaatgaggtggggttctgtttttggtggcagatgaaggactttgcagacttccggggttggaggagcctgactggccagcacaagaaggagcaggagaagaagaagggctgggcaggaggcattgccagtttgcttttagaagctcattcctgctccagcttcttttctgttgcctttcaggaactttccaggaaaacattataagttctctgtgaattgaaaatgtctttttcacagattccagaggttctaccactagagactgattttttgttaaatttatttcttctatattaaaaatcagagtcaaatatttctgagggaggggaacacaaatatttaaaaactgtggtataaattagtttttatgttgccttctgaactatctgaggatggagatgtgcccagggttgctggggagaggttaagtgctgagagggtggttatgcctgggagaagcagggtttcctgctaagcttcctttgctattggatttcttggctttcctgaaggttttttcaggcactgcaaatgacaatcaaccaaacagcaaggttttatttcaaaggataatgcatccagcatagaactaggccgcaggaagaaacataaaaacaaaacaaaataaaaacagaagaggtggtatcagctgacaagggcttatattctaagtgggtagacaaaataggcctacgaaaataacaagctggccatgaagctacatagcagaatatgcgagggggcaacgtgctaagttgtgtagtcataagccaggcatttagtaaggtgctaattatacaatacaggcagtgaatgtgaaaggaaaagggaggttgagatgggctgaggtcttctaggaggcggggagggagtgcagccttgacaagcctccctgtgggcgaggtgtaaagaggggcagaagtcagctctggaagcatagggcagtgggtggggaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcctcacccagaccaattcaatcagaatccctaatagcagagctaaacaagggtaaggtctaaaagcatttccaggtgattctaatgggcagccaatactgagaaccactgttcttatgtaagaagcacatcttacctatatttcctaggaagaccagttgatgaggtcatatgcaaaagttcccatttattggtttagtataattgtgcaaattagaattaacccctaagtgtataaagagtagagctggttaaaaacatagcctgtgctaagtttaattgtacagtaatttacatttgtgtggtacttccaagtttcccaaatgccctcatatttgttatccacctgtacatttaaaccaattcccagaggttagaaaaggattcttatcttatctgagagacagtatagcaccatggttaaaagctcagactctgacaccagacagtctgggtgcaaatcctggctctgctgttgccctcagacaggatttcttagcttctctgtgtatcagttttctcatctgtgaaaggaggatgaatataagaccttatgcgatgctaatgtaggattaaattccctactacaagaaaatggtcttagaacaatgcctggaacatggtaagtgctgtataagtgttaactattagtatgattcccatttgtttgatgcaggcagaagctggagcttggagttgctcagagtggtagagctgattttaacacagatgtttttgttctactaaactgcatcctcagaactcctatttactgctgtcagttatgttgaagattaagttatatggttgcaaaatatgtgtaaactgagaagataaaaggttaccttaaagtttcctttcaaatgttacttctttttttttttttttttttttgagacggagtttcgctcttgttgcccaggctggagtgcaatggcgcaatctcagctcactgcaacttccgcctcctgagttcaagcgattctctcctgcctcagcctcctgagtatctgggattacaggcacccaccaccatgcccggctaattttgtatttttagtagagacagggtttcttcacgttggtcaggctggtctcaaactcccgacctccagtgatctgcccgcctcagcctcccaaagtgttacttcttaactgatttcacataggccaaacaaagactggttaagagttgaggctctggaattgcactgtctggggttgactattgcagttgaccccacgaagtctgggtaaattatgtactttttttctcagttttcttgtcgataaaatgtggcaaataatttcatgagctgatacaagtaaggtcttacaacagtgctagataggtaataagcttaacttcataagggctagtttttatgctatttattggttcatggttagaggaggcctgggacaataagcagggcaggggacctagattctggcaaagtaaccaagtgatggccttgaccattctgggctctttaccccagtgtcatatgccagaggacccatcaccagacggcaggaccgggaacagggagggagttcatcaggcagaaggcccctgtggagtggtagtaccagcaactgaagaccaaatgggagctatgtctggttgctaatctccaggccaggccattcatggagatcggtggtcctgacatgcacactcctccccaagaccacagtggcacggctatttcccagcctgaacctggggaaatgaaggtgcaaatttcttctctgtggctcatggacccctggggagagagatcagaagatgttctattggacccctgtgcagcctccccacaaagcctgtatgtttccacccttttgccattgcagactccagggaacaccattggtcactcggctcttccctcttgtttcccaagtggtcagttgcttatgtggaatgcaaactctccttaattacttgcattagcacaaaccctggcttctttttgaacctaatctcaaaccttagtccaagtccctatcctaatactatctgtaatatttaagctattcctaaccttaatgctaaaattgtacttaaccccaaagtcaacctggttaataggcagaagttttaagtaacccttatacagagtctgccccttccccaccctgcatgtagtgatgtcatgcttactcagggctgcttctgtttcaaagaccttgatatctttgttctatgaccataactgtgaatggagacattggtgcttttatttcaaaccaaaaattccaaatgaaattgatacatctaatatcccaagttccactctggtcccaattgtatctcgaacttatccttaaacctaaccaaactcattatcataatcttccctaaacctcaacatgcttttcactccatctatcttcatctgtccccaaggtgtaagagaacccaggcctaaccctgcctccaatctggctctgtccccaaactgatcatatatcctttcctggttttatggatagccctctgcagcccctcttacctgctgcagtgtgttctctatgacccctgtgctttccatctgtcctctttactccagagctaactgtatggctatggctaaccagaagccgtcctggccaactgtgactgagtccctcaaggcaggaggaacatgttctggggaatttgaattgtgcaggcaccacccttgtcttatggattggattcctaagccaccttttagcaacccagacccttaggtagagggatgagatgtgaggcttctgctgcatcctttgaagactcccctggatacctgagccctacctgagctgctggggcagactggaaacctacctacagcgcagcatgcatgggggtgatggtgttctttttctcacattcttcttgggtcagatcttactcatctcttcaaaactcccctcctgcatcttcttgcttccacttacatgttatctcttaatgaaatgcactagttcatgatttcacttatgccacaaatatttatatttactgagcattcgctatgtgtcagatgctgagaaaacagcaaaggataagagtccagagcctcatgccctccagggtttcacagcctagctggaaataagtgttataggcttaagggaaaaggttacatactttttttcatttttgtaatttaatgttaactttattttaattttgaattaaatatttttattgatatgatttcatatttgaagttcaataaaagaaaatattcactttctgagtttttttctggaactactatttgtttcatttcatgattaccaaaaatgattttgtcaaatagaagaaacgaatgttaaaatgacctgctctggtatcaaatatacaaggtacaccactgctgaaaatatcagtcattgatttcatgatgggccagatggatactctgctgttcaaagtgttgggcttaaaggctccagtcccatggttacacaaagggcttggccaatcctcccctctctgccgtgaagctcaggctgccctggggaaatcagcttcacttctggcttctgccactcatctctgttttgtcctccctctagtggctgagcacggtgccaggttccagattccattgcttggagccatggccgcgacgctggtggtcatctgcacagcagtcatcgtggtggtcgcgttgactagaaaggtaatggctccggctgcacaccgcagtcatgggcacccccacgtctggcacccgggtcctttcaggttctctttccacccagagagagacccagatgtgatcttcccgagtgctctttgtgcctttttcctggcatttgttctgcctattagtgcagttatttatgctcttccgttgtccctctcatagggagggaccccctggacagctggacctgtttcctacccatcttgctgtcatttgtaactcctggtttctgcttatcccttaagccactgctctgagagtttaatttatctactatgattttgatgcatcgtgggcatctatatatgctagagctttctgcacattagctcttttgattattacaactctctggtagtgctaggttacccagcatgtctgtagaatgagaaataaacactccaaaaatgtagggttaggccaggagctgtggctcacacctcagaagccacagatatggctggtgctattgggaaagtcaatgatctgtaatattttcatttatgtgttggctatcacaatagacataattccacccactcgggagactgtggcgggaggatcacttgactctaggagttcaaggctgcagtgagctatgactgcactccagcgtgggcaacagagcaagactctatctctaaaaaaaaaaaaaaattggtggtaaagtgggcatggcaagatcagcaggttgtaaatcctctgtttagcttaagagcttatgtggctgaaagagtaatgaatggggaattgaaagatctagtttctagttttggcactgagtgtatgcttttaggaaagttacttaatctttcaaggtcttcatttccttatatataaaatggggatttgtcttagtctattttctgccgctgtaacagaatacaattattgggaaatttataaagaaaagaagtttatttggctcatggttctggaggctgggaagtccaggagcatggtgtatttggcgaggttcatcccacggcagaaggcatcatgtgatgagtgcatgcatgtgagagagagagagaaatgaggccaaattcatccttttaattaggaacttactcccatgatacctaacccactcctgagataatggcattaatcccttcatgagggcagatcttcatggcctaatcacctcttaaaagcattaccacttaatactattacaatggtaattaagtttccaacacatggccttttgggggacacattaaaaccatagctgtattataattcggcttactctatatcatagagttgtgatgaacaagtggcatatttcatgtaaaatctttataaataacaaagaattatatcagtgaaatttatgtcatcagctactggtattgattgggaggagtgaaagaatttccactccttgttttgtctgatctcttgggccctttaagtcagctcagcccaggtcaccttaattcaagtcaccacataaatattttgggaaacacaagtttgtaatttctacctttaccccagaccctccacctgagatcctaacccacttttcctccaactctaattccattcaattaacaactcagttctgcagcctggttgaactgcagtggctgagacatggctggtgctattgggaaagtcaatgatctataatattttcatttatgtgttggctatcacaatagacataatgaggaaatgaaccctctatgggaaggtgaggacaagagaaatgattgaatagaggggggaggtgaagaagatgaaagttgatctcttagctgggaagggagctgctatggtggttggtgaacaggttctctgctgttagcagtgtcctgatggtctggaataaaagaatcaaaggctctttagaaggagctgaacaacttttcctgttaaggattcaagactggttaattttcattctgggcacctggactaactttggtcatctggagggtagagaaagagaaaaaggtgaagagacctattgagtcctgttgctccctttctacagtgtttgattccccagccctctctgacatttccactgcttcctgtgtagtgtgggtcctctctgcatctttcctgtgctttggatatagttgtcagtcttctgtctctctctccttgctcaaagcattttatagttgcattattcagggttccagcagggaacatgtagtactcaaactgggttgtttgaagacagtttaataataggatttccagaagtctagtaggatgtaaggacaccacaaggaggagtagcaaggtgctgtaaccattcctagttcttcaaagggtaggggaggggctaattattggagcctggaaggagagagttatgtggaggggtctccttcagaagtgctgtagtctttgctggagggtcacaaccagtccaaggccaccctgcagaaagaacaaagggaactacataccctcatctcattcctctctccattcccctactgttgctttgcattggctgacctcaaacttaggatggaggataaggggactcattgatgtagtacatttagtacagtcttcatagggcacagaatagggtggagaaggttagagagcagagccaagaggcaaatggctggtatccattcaagtagtgctcatagacatgaacactggacaaaggatcttgactttccacagggttggctggcttcagccttctctcttgtagtcttgacctcttttgattatgtatgtaagcaatacccttcttggctgcccagctgtatctctcctgggcacactgtgctctattaaccattttaatattcccatggatcaggctttcttggctcccattgaagtaattacatccattttgtttctttaagtgctgctatctgttctgtactattttgggatctcctcatcctcattgctactaggaatccagttctgtaaaagcatctcctattttagccctagcctatagaggagagatgccaccaaacttctcaatgatgctggagctcccctagcacattcttttccagcttagtaaaagggatattctttttctttttcctttttcccctttattgttgctattatcttaagggatgttctctggatcttccctagaaaagtcaatataatcagctattggattttggaaattattcagtacagggattggcaaaatttctc

SEQ ID NO: 269 - DNA, 3149 bp, Homo sapiens
  cDNA TIGIT-002
atgttgcccttgattctaggcagagacaggaggcatcagacagctgtgacagccatggagctcccctaccacttctgagccagagggaagactttggagaagcagaagcccaaagacactgctgggagattggtctgtgctctgggagaaccctaggttgtgtttcccgtgtacaagccaccgatcttgtggaagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatta

SEQ ID NO: 270 - DNA, 2967 bp, Homo sapiens
  cDNA TIGIT-201
cgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatt

SEQ ID NO: 271 - DNA, 3710 bp, Homo sapiens
  cDNA TIGIT-001
ggagcttggaggagagagcacgaccccctgctgctgccgcaggatgttgcccttgattctaggcagagacaggaggcatcagacagctgtgacagccatggagctcccctaccacttctgagccagagggaagactttggagaagcagaagcccaaagacactgctgggagattggtctgtgctctgggagaaccctaggttgtgtttcccgtgtacaagccaccgatcttgtggaaggtaccaccactcccagccccgcttggctgagggctgcgggccacaggttttcaggaccgtgcttgtggttggaggctgtggactcaagtgcggctggcccgggactttcacagggcgcagggcgggctaggggaaggcccagctgtgaactgataagggggttttacagtctaggccagcacttcttcccctttcacgggcaaacgtgacattctttttcagcacctgtactcacccagctgcatcaaggcggaccagacttgtccaactcacagccccaaaagtcagggcagaataaagcacagtggctgattttagcatttttaaaatagaaatgtgagtcagcacctgatggacctcacagatccctgctatgccacgagggctgctgactggccttaaaagctcagggtggcccggggagctctcagagcaggcctgcttctcacagctgagccgctcagtgctgggggctggtgttgagtgggtgggaaccagccaggttccccgtggagtctgtgcaggaggctctggagggtctggggtagattccctggggagagacttctgtcatttgctttcctccaaggcagcctcagggtctagctggcaagtggtcactttcctgcagaaacatgctatcctcctgttctatcagataaggagggcagaatgaagaggttgggtggaaccctggccttggagtctggagactaggattttactcttgacaaagcacattatatagatagggatattgtcctccaattttcctttcacttccttaattaatattgttatcaatactactgttgatgtattgaactcctgccatcttccaggcactgtgctgaacacttcaccaaacactagagaattaaatcctcacaaccctatgaaagaggtactcttattcctatatgcacatggggaaactgagccttcaggaggttgagaaagttttccaaggtcaccaaacaggatgactttggacccagtctgttaatcatccccctctagagcaccattgatcaaaatggacttgaccatattcctctttggactggttacttagcaaaaaacagaaaaattatttaacaattgtttaaaaccacctctaagtttctctggatatctcattatataagagaggtctcacctctttggctcccacccagctcaactatggaaacacaggctgtaaatttttatagcccaaatcctagtgtccaccactttctgtgctctagtcccactagctgctcttggccctgccactcctggctccccggccttagtgagtttgggaaacatccctccagttcaaccttggcaccttcccttggacacacattaggtattatttctccttcagctgaaggctttgtagctattgaaaggcaaggcatctcttgatgtgagccttgaaggacaggttgctttgggtaggcagagagaagctggtaaggcgtatattgtctaagggtctggaggtggggtataaggggtatacaagtcatagagttggggataggcagaacccagagaggggagaaaactggcctgagatagaagaccttgcaagggagaaggagggtaggagcctggatggtgtgaaatgctagaggtgcatggctggaatggagggggtggggcaccaggcttcagatgcttctgggtgcagatgcagattttcaggatgtacaacatggagcatccccaaggcaactgtgttgagagcctgcgaggcaggtgaatgtggatcttctaccccctctcctgactgagttcaccaaggaacaagctttgtaaactatttgaggctcccaggggctcacccttctttgcatttccagctctcatgaggtcattgtgcacaggaaagctctctcctctaatctcctctgatcctactgcaccagagaaatcaagccagaattcaataaagtctcagtccagataaacaagacaaaagaaataagattcgagtagaagatctccttcaagggaaagttgctgtgtttgtccaagacctttgtcccatccatgtatcatcccccaagtaaacacttcttgttcacctgttcattagatttcaagtgcagtccctggcctgtaagtccctacaatgataagcttctcttatcattgcacattcttcatcaggaggatgccagaggagctcagccaacagttcctcatcagtagcagattcttcagaatcttgggcactacacagatgcccttgagctctttgaataaaggctgatttttagaaaaaacattaagacagaacttaaaaacaatagattgactataatccaaagacgagtgtacctctaaccacaattttcatttatttttaaatgtttccttcatggcctttcttgtggctcaccctatgcagtttgtgtatttgttgacaactttatgtgtttttaatatggtttttgccaaacttggtttttccgagaccgtcttttctcagaggctcagttttaccgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttca

SEQ ID NO: 272 - DNA, 587 bp, Homo sapiens
  cDNA TIGIT-005
gaataggaacagctccggtctacagctcccagcctgagcgacgcagaagacgggtgatttctgcatttccatctgaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagcc

SEQ ID NO: 273 - DNA, 559 bp, Homo sapiens
  cDNA TIGIT-004
ctacgaaaataacaagctggccatgaagctacatagcagaatatgcgagggggcaacgtgctaagttgaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctg

SEQ ID NO: 274 - DNA, 250 bp, Homo sapiens
  cDNA TIGIT-006
taagaggtcgacagagtcaagtgcagtaaacagtacaagaaaatagagaatggaaagctgcctcactaagcttagtgaacaggaagtaacaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggact

SEQ ID NO: 275 - DNA, 571 bp, Homo sapiens
  cDNA TIGIT-003
acatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcc

SEQ ID NO: 276 - DNA, 9238 bp, Homo sapiens
  1st Promoter of BTLA
acatctcacgccagtcagaatggtgattattaaaaagtcaggaaacaataggtgctggcaagtctgtggagaattaggaatgcttttacacggttggtgggagtgtaaattagttcaaccattgtggaagacagtatggcaattcctcgatctagaaccagaaataccatttgacccagcaatcccgttactgggtatatactcaaaggaatataaatcattctactataaagacacatgcacacgtatgtttattgcagcactatttacaatagcaaagacacggaaccaacccaaatgcccatcaatgatagactggaaaaagaaaatatggtacatatacaccgtggaatactatgcagccataaaaaagaatgagatcatgccctttgcagggacatggatgaagctggaagccatcatcctaagcaaactaacacaggaacagaaaaccaaacactgcatgttctcactcataagtggaagttgaaaatgagaatatatggacacagagaggggaataacacaaaccagagcctgttggggagtagggggagaggagagggaacttagaggatgggtcaataggttaagcaaaccatcatggcacacgtatacctatgtaacaaacctgtacatttctgcacatgtatcctgttttccttttttagaagaaataaagaaaaaaaagagtagataataatatcaagagtaatttatagaagacttttgtgaactccaaatttttatttgtggttgattcccaattgtcacccaatgttactttaacaggactattaaactaatgaaatgttggactaaaagaaaaaaaattagctaaatatacacagcactgaatggcatgccatgcactattctaagtgttttacagaattaattcacttaatagtcacaacaaccttataagattattctcccatttttttagatgagaaaactgagaaccagagattttatagtcacaaaaccattaaatggcagacataggatactaatccatggagtctggctttagagtccctgatcttagccactataccacacagcttctccaaggaaaaaagaaaatgattattttttggacctgattacaaatgcctgtaaatatttttcttttaacaattctgaactctacataaagatgaaactcacaaataatggaaattaagtaggaaagtcccaatgaggcaagataaatagttttgacgtcaactttacaatagaggaaactttggtagtaggacagaggaagcaagaaatttaaaaacttctctgtgataggaaaagtatattcaaggctgcaatgagcacaaggttaatcttttcatgctttaattcaagaagtcctgtaaccacagaatgcattcctaaacatttatttaatatatggcaggcattgttgtaacaatacataggcacttggcagaagacagagctctatctctagcattcctccatatgcacatttcaataagaacaaatagctgaagccatagaaatatgccttataaagatactgtgctacaaaacctgaacttcaaggaatgatattttttgacccaaagatatggccagtttgtagtagagcaaaacaatctgtgtgggatgtggaacacggtgtttaaaagctggtccatggaccatactggaccatcataataaagggaaaaaaatgacacaagccagaccaaaatggagacatagccctaaccactgtattctcaaaagagccagaatacaggtgtctttcccttactgaaccagactaggattgctttttttaaaaatcacaataaccagtaatcaatcaaacagttccaactgcctttattctgcatcatatatggtgttggtgatacccagacattaactgcagtgttcctgcctgcctaaaagtggaatccttggttgatcctcaactgaactagggtctagggcagcctcagacaaatggtccaggatgacagggcaggcaatggacagagacacttccacttgcagtctagatcttgccagcatgatctgcccatgaagggaagatattgacatttttattacttctatcaggacagaaactgtatgccacacactgaggggcaagtttctctaattttttagagaaacacaaaaagtaagcaagcatacttttgtaataaagaaggaccttaaacaggaagtttgtagagaacattacattttttccagccttattatatatgcagcctcactcctaggaacaaggacacggatctcacattgctttgaagtagggggaaaaaatcttcaaaggctatctttaaacactgaaaatgtattactgtaaagaactcagcaattaagtaaatcacaggaaatccccaagatataaggtatttaatgtggttttaagaaatggagccatcagctctgcctgggagaacaaatttcaccaaatgttccttctcttaacctatagctttaatttaatgcaactgctgctgcaatccattatatcaactggtatatatctgaccagtacttcactcaagtctttcccttttttttttgagtgcagtggtgtgatctcagctcactgcaacctctgcctcctgggttcaagctattctcctgtctcggcctcccgagtagctgggactacaggcacctcccaacacacccagcaaatttttatatttttagtagagacggggtttcaccatgttgaccagtctggtcttaaactcctgacctcaggtgatctgcccgtcttggcttcccaaagtgctgagactaaaggctagggccatggctcccagccatatttcattttctgaataatttgattcactatattttgggctaaatatattgcaaaatatattgtacttatttattttatttttaactttaaaaactcaactattttaaataataatgttaaaacataattctcatttaattacatagaggttgcatggtgaaaataatttaggaaaaataccactaacatttactgagctttaaatacgtgcacttactatgcgaggcactttacccatattattgcatctacagtcttcacagcagccccataatttaggtacaattattacctgtattgtacaaatgaggaaactaaagagaagagaagagacttaatcaatgccatacagtaagtggcagagccagtaaattaacccagttctaacagccaagttcacttttgcaaatgctaggttgcacattgggagaaataaaggtcttaccccaccatcaatgtggtttagcactgaaactcattgttcttaatttcatagagagtagtttatgtatccttcaaatggggaagaaatctatttaataatatttgactccagttgtagctatgtgactgtaggcatctgatggaaggtggaaaattcagtcaaccatctaagcacctagttgacttaatactagatacttacaaacataaagatgtttgagtaactaaggacttttttactttgcacttggttgtgtggcatcctggcatcatagagacatattccaaactacacagtttaaaattatagatagactttccatagaacctcagtggccagattttctaatttaaaattgcagtagccaaactgataaatgtgtgcttgtagggaataataagacagaatatttaaaacctgaaaaatcactgggcatggtggctcatacctgtaatcctagcactttgggaggctgaggcaggtggatcacttgaggtcaggagctccagaccagcctgcccaacatgcattgcatccatagcttggctgactttcttaaaaaacaggttgatggcaagaaaagagaactgagtagatgttataaatagttaagtacaaatctatcactacttcttgcgaaaatgctcaggctgccacactgatgatgaatagatagctcgttcttcccaaactgagtgcagtagagtgttgcagtgctcagttgggtaggacagatgttggataattggggttatccaacatctctactaaaaatacaaaaattagctgtgcgtggtggaaggtgcctgtaatcccagctactagggacgctgaggcaggagaataaattgaacccgggaggaagaagaatcgattgaacccgggaggcagaggatgcagtgaggcgggatcacgccattgcactccagcctgggtgacgagagcaaaactcttgtctcaaaaaaataaaaaaataaaacctgaaaaatcagaagcttctgatgagccactcataggcttttcctcttgataatatgtgggttcctatgcaatataaggtaggaagcgactttacaataaaaaagaaattgcctttttttttttttttttttttttgcctgtataaagtctttgcaggggtggctaaatatcatctttgcagaatccaacttattttctgtgttcaattgacaaccaagtaggaaccattccctttcaacaaaatagaagcaatgacgaaaagttctgctcctatattttgtagcattttctcaatcggtattctcaaggcatacatcccaatgaagcaagtatagagattttatttagaggtaatattatttgagggtaaccatggagatatgtataattccgattatccaacaactgtcctacccaactgagcactgcagcactctactgcactcagtttggaaagaacgagctatctattcattatcagtatggcagccagagcatttttgcaagaagtagtgatagatttgtacttaactatttataacatctactcagttctcttttcctaccatcaacatgtttttaagaaagtcagccaagctattgatgcgatgcctatgattaggcaggtgaatactatgttctaatttggtttatgctctacgatgtcttcggtaagcaaatgtaacagcttggtttcatctacgattacccacttcgtataaacgttacaccgtactaagttcagcaagggagaatgttgcctccaagaccccctgagaaataaaaccagaaataacctaagcaggtgccttaccatggatgttccagatgtccagatatgggattaagaagaagacccaaaataatttcccagttccaagcatggcaggcaatgtcttcatttcctgcacatatcagtgatggaaaaactgctcaagtagaaggctttgcttcgtcttctgagtgctgcagagttgggtcagtttacctaccccagtggcatctgtgaaataactaaaaaaaaaaaaaaaagaagagagaggtggtaagagaggagagtaggaagagcctggatgattttgtgaaaaaaagtgaacagaaagacgatgtggtactctgttctgtggtttttgcttcttgtcaggttggctgttcactttcaaacactgtgatctgcaaagcagctcagtccttaacttctccttccgctctaccacgtttttgccccaggttgaggtttttcctgcactcaatgttcagtgaaatgagcaattaaactttaaagaaatctgtattgttgcagtctttaagttgagattttaatcaaattaaggtcaggaaatttatggtaaaactatcaatggtaagtatacattttcccctttgtgatagcttgtgattatgaaacttcttttatgtaaaagattttaggtttcttttttttcctgtacatgtcacggtaagatgaggatgcttattgtcattaaaccagtgaagatttatctcaggttatggagaaaatgagtgacaggaagcacttcctcaacagaagaaggaagagcagccgtctttaatctgtggatacatatcaatggaacaagatcatcattaatattggctacatgttctctctagataataaagttctaatctaaaggagatcttgaatatcaattaaaggaaatttccattttaaacattcttcatgcagttgttgtctcgatgaagtagaatagaaacagtaaaggaagaaatggaaaagttcaagatcagatagcacaggccaccataggactgttttctccacatccacttgtaataattagcttagcttatagtcataggagctaatcaaattcatctgccatttgagactccaaatgagagatctagatttgtggcattagtgatcattgacagaagtcgattatataagttttttcctcagagactgatgattttattccaaggccaaacttcaatagttttaagttcaaggaaagttttaagagcaaggaaagtgtatagattgctggacattttgacctgacatgggaaactgatgggcaatacttaattcagagctcccagttgagttgccaagggtaaattaaaattaaaaaacagttatcatgtatttattgagtcaaatagacaatgtgctatggttggagatgaatgatgaatgagttgctattgctgattttaaagaactcgttcaatcagtattacgacttcctcacatccacctttagtgttggtcttataatatagtataatacagagagggtacacatagccttttagaatttctgttactaatcaaataaacatcctgggaaatattaaggcagtattttcacagctccttccttttcctgtgttcacagtgagtaaaagcttcttgaggcagctgaagcaaggctcattgtccctttaaaatggcccacaggtcaaaagccataaccttatggcttatgggttacataagcccaaaccagagagagatcatattaactttatctcagcttaaaactgttatgtcactattttaaatatttttcatataaaaagtccatgctaattagacaaaattcggaaaaaatcttatgtagcatctaatgtatttttaaaagatttatatatttcttgcttttattagcatgcctagcactttatccctccacaggtagagtcctgagtgtcccactgtagataaaaccctgcctctgaatctcactcctgtcttcgttctagttaaaaaaaaaaaaaaaaaaaggaaagaagccagactcagaaattaattagctcagtaacaagtcaatcttgccttaagcttataacttttgtaatcccatcataattatgtatattgtttgatccaaaaattacaattttcatttatatttgcaaatttaaagagtttactacattcttgaaagcgatggcattacatattgaaacaattttaaaaacatgaacgtctaatcagttttatgttgaaagacaaaaaggaaatagaatttagtatcttcaaactctctttacaaacatctcaggaactacttggagggcaaatttttcagttcacttgcagactcagttgctttcatgaatgatgaagcagctatactttctgcaatatttttcccccaggtgatcagagaaccagcaatcacaaaacatgacacaggatcctggaaaagtcttgcccctgatgttagacaaccccaaagagatgaatcttggtactgatctttttaactttccccaaaaacattccatagctttactgtaaaagtagtccagcatttaaaatctttgacatttttctatttgatatcattttttcactaatgttattgtaagcaatagtttctatacattactgtgttctataatcaacctggacactttttataaaattggtggaattttttaatcctatccatttccattgaatcagaatctcacaagatgaaggccagatatccccattttcagaaagctccaaaggtgattttgatatactagtttgaaggaatatttagaaaccaattatgagttggcaggggatataagcttttgaatcacacatgtggtatcaaagctttttcagttattagctatagaagctttcatagattttctacgttcttagagtctgtagtagacacagaaatgcacttctcagatcccccttcaaggatgtgtttgctcttagatggggggaatgcaataggcagagtacatccaactgtaaacttctcccaggtctgctcagttgagacacatcttgaccaaggtcatgctttcccatgacagcttgcatccaatgatggagcaaggaaagtgtacagatttctggccattttgagctgacatgggaagctgatgggcaatacttgattcagagctcccaactgagttgccaagggtatattaggcctacatcacagtttcttcctctgatcccttcctttcacagttgttgatccctaatctatctatgtttgcttccagagaaccaaatctgctccacatttcattttccagttctttaaaacatagtaacaatacctatctgttttgttggttaactgaggtgatatatgcagggtaatcagtaaattgcaactataatcattctggaaccaagaagccctgtattaataagccaaaatttaatgatggtggaacaagttgaaaatggagcaagttgaaaatacttgctaatgggagtcattgttgcatagagatcaagactctaaagtaaatgccgtaataaagcttcgattaggagaggaatggtgtagcttaaagatggtccaaattaaaaaacattcgcaaaggggccttaggtctatatgtagcatctcatagttccatgtcttatgaactaaaaatcaagtaatatgcacccaacatttccatgatagtgtttaaaaaattttcataagaaatgtttgattgttgagtgaagtattatttgtaataataaaacataataaagtgaggaagcctcacttttaggacaattggtctccccacatgaagaaagaatagagtattcatagttcaaattcttatataacagtaatcaattccaattgaataatatttagcccattttgataaaaactgctatggtttgagtgtgggtgtctccttgaaattcctatgttagaacttaacccctaaaatgatggcattaagagataggggcttttggaatgtgattaggtcatgagggctctgccctcatgaagggagttaatgtccatatgaaagagccttcaggctgggtgctgtggctcacgtctgtaatcccaaactttgtgaggccaagtcaggaagatcgcttgaggccagaagttcaaaactaacctgggcaacatagtaaaaccctgtatctacaagaaacttcaaaacttagctggatatggtggtatgtgcttgtagttccatctacttgggacgctaaggcagga

SEQ ID NO: 277 - DNA, 11504 bp, Homo sapiens
  1st Enhancer of BTLA
cagagaaccagcaatcacaaaacatgacacaggatcctggaaaagtcttgcccctgatgttagacaaccccaaagagatgaatcttggtactgatctttttaactttccccaaaaacattccatagctttactgtaaaagtagtccagcatttaaaatctttgacatttttctatttgatatcattttttcactaatgttattgtaagcaatagtttctatacattactgtgttctataatcaacctggacactttttataaaattggtggaattttttaatcctatccatttccattgaatcagaatctcacaagatgaaggccagatatccccattttcagaaagctccaaaggtgattttgatatactagtttgaaggaatatttagaaaccaattatgagttggcaggggatataagcttttgaatcacacatgtggtatcaaagctttttcagttattagctatagaagctttcatagattttctacgttcttagagtctgtagtagacacagaaatgcacttctcagatcccccttcaaggatgtgtttgctcttagatggggggaatgcaataggcagagtacatccaactgtaaacttctcccaggtctgctcagttgagacacatcttgaccaaggtcatgctttcccatgacagcttgcatccaatgatggagcaaggaaagtgtacagatttctggccattttgagctgacatgggaagctgatgggcaatacttgattcagagctcccaactgagttgccaagggtatattaggcctacatcacagtttcttcctctgatcccttcctttcacagttgttgatccctaatctatctatgtttgcttccagagaaccaaatctgctccacatttcattttccagttctttaaaacatagtaacaatacctatctgttttgttggttaactgaggtgatatatgcagggtaatcagtaaattgcaactataatcattctggaaccaagaagccctgtattaataagccaaaatttaatgatggtggaacaagttgaaaatggagcaagttgaaaatacttgctaatgggagtcattgttgcatagagatcaagactctaaagtaaatgccgtaataaagcttcgattaggagaggaatggtgtagcttaaagatggtccaaattaaaaaacattcgcaaaggggccttaggtctatatgtagcatctcatagttccatgtcttatgaactaaaaatcaagtaatatgcacccaacatttccatgatagtgtttaaaaaattttcataagaaatgtttgattgttgagtgaagtattatttgtaataataaaacataataaagtgaggaagcctcacttttaggacaattggtctccccacatgaagaaagaatagagtattcatagttcaaattcttatataacagtaatcaattccaattgaataatatttagcccattttgataaaaactgctatggtttgagtgtgggtgtctccttgaaattcctatgttagaacttaacccctaaaatgatggcattaagagataggggcttttggaatgtgattaggtcatgagggctctgccctcatgaagggagttaatgtccatatgaaagagccttcaggctgggtgctgtggctcacgtctgtaatcccaaactttgtgaggccaagtcaggaagatcgcttgaggccagaagttcaaaactaacctgggcaacatagtaaaaccctgtatctacaagaaacttcaaaacttagctggatatggtggtatgtgcttgtagttccatctacttgggacgctaaggcaggaggatcatttgagcccaggagttcaaggctgcaatgagttacaatggtaccactgcactccagcctgggcaatggagtaagaccccatctctaaaaaaggcttcggagagctgcctgcacgtccatctcttctaccatgtgaggacacagcattcatccctttttgcccccttccaccttgctgtcaggaggcaataagaaggcaccattctggaagcagagagcaaccctcaccagatactgtatctgctggaaccttgatcttggacctcccactcttcagaactgtgagatatatatttctcttctttctaaattactcagcttttatagtgagctatgattgtgccactgctctctagtctgggtgacagagcaagacactgtctttaaaaacaaaggaacaaacaacaaacaaaaattactgtttaaagtatattgtcttaccagcacaaatggaagaagatagtcacataagtttctgcaaagatgttttccaggccatggtgcatcaatggtccctattagaaagctactttaagctaagggcaaaaaatgtcaatatgactaattttcagttgttagggaaataatacatagacacacacacacacgttcctattcagaaaagggaatagaagaaacataggtagccactggtcaatagccagggtgccctgctgcagcagtgggtgaagttttttaatttgcccacgcaatagccccagcctctgatccttggaaggtctttctagtttttgaaaataaagctcaatgggaagcagaatctgaggcagagactagtgtgcaggaagtttattagggtgtgcactgggaatcattaagcgtggaggcagaaaagagaaccgaattcagcagagagtaaagggagacatcaggatgtgatacagtctcagcaaaggcctcagcaaagcagaagaaggtctgaagctgagttgatcctttatagttttgagtttggccaaggaggttgggactttatatacctgcaatgaccagtaattggatgcaggctgtctccaggaaaggggatttgcttttgggtaaagaacttctcttcagcagtggaaaattcccatacaagactgaaggctgagggctcttagccaggaacactccccacagtttggggaaataaattcttcagtcctgaagaggatctgaatggtgcatccatagcttccactacactagctctctttccttgatgatcacagctgaggtgggcattagagaagatggctttgggggatacacagcttcatcattctatttcctggttgtgcaagttagggtccaggtagagttttggtgtttaacatagtctattataaaatagtcgtagagttctctcaaacatctggtaggatttctgtctattctctttcagtaagttttgtgcacaaataaccgcagttaaagaacttgtgcagtcatggatttttcgagccaaagagacttactagccattatgctctgcccagcctccagttcacattataatgatagctatcctgagactatttaaaataggacttggtagaaaggcaattcttaatcttctctttatgagcgagttcccactgtcaggcaaagaactcttatagaactttttgtaagagaacttggggtcagaaacttatccgccttctaaggctacagttttacaattggggtaaggaagcagctggtaaaataaaaaaattttattttttagggtggctttcacagcaaaattgagtggaaagtactgagttctcatatagtccctgcccccacacatgcacagcctccttcaccatcaatgttggcattagtgtaatacatttattacaatccatgaatctatgttaacacatcagcatcacccaaaatccatggtttacattagggctcactcttgatgttgtatattctatggctcttgacagatgtataatgacatttattcactgttatagtaacataaagaacagtttcactgccccgtgaatcctttatgctctgtctaatcatcctctctccaccctaacacctggcaaccactgtttctatagtattgcttttcccagaatgtcatatagttggaatcaatgcagccttttcaagttggcttctttcacttagtaatatacatgtaagtttctttcatatcttttcatggctttgtagctcatttctttttagtgcttaataacattccattatctggatgtaccatagtttattcatttatgtactgaaggacatctttgttgcttccagattttggcaataatgaataagcttctgtaagcatctttgtgcatgtttaggggagacatatgttttcaattcattgagtaaatatcatagttgaattttttaactgcaagataccaaattactgaaggctcagcctacttagattgtggaccacaggcccacagcctctcttagccaagtcctattccttctacctcgagtttgagttgatctgcgtcttcatcctaacattttggttaatgtttcaggcttagtcagcatgggttctgccatgtaaggattgtttaacaccatataactaggttcactagctttccaggctgaaaattcaaactcttagtatctttctgcctacttcctccatgaaaccaaagccacaatttagattatgatatactctgtatacagtcctgataaaaatgactagttcctacaatagtctctgactagtttaatgagaaaggagtcattttaaatttcttgaagtgccagaaaatgaacttagatgctatatagtgagaagtaatacagcaaagagaaatgtccaactatccaacagagttgcattagcaaaaatcatgctgctgcctctgtgctcagttcctatgaagtcagaaactaaaccttcacccatactgttctggaaaaaattacctccatgacagtgctatcagaaaagtcacaagcctcatgatgtccacaccatattctaagtcttacccagctgtgtgctcaaaagctgtcacatgcagactcccaattgcaagggaggctggggaatgtgatctttaacttgcctgcttccagggtcccagaagatttgaagataaaaagtagttggagtggctctgaaacaagggtggttttatcccacagggaaatttgacaatgtttggagacatttttgcttatcacagctggtgtggggttgctatcagcatctagtaggtagaggccaggaatgctgctaaacatcttacaatgcacaggagagacctcacaccaaagaattatccagcccaaaatgtcaacggtgcaaggtgagaaaccctggtgtaaagtgagcagacctactgtatctacctcaaagtctatcccctgattgattgatagtccttgatggcagtgaaggccctaagattcatttctggagactcacaaaacagaaatctgaacaccacagtcttatgctctccccgctgccacctctccctctgtcacacacacacacacacacacacacacacacacaatcacttattttaaaaagcattgaaataaagatagagactatgttttatgaccacctgagtttcagtcttccatcccacttcccacctgcccctgtgttattgcatcttgagtctagaaaagcttatgataaatataaaactcttcttcaatccaaacttgaagaaattgagcatgtacctacatcagtctctcaccacactcatctctagttccgttttagactgggttccctcagaagcaacccccagttcaacgatttgagtgcaagtagtttatttggaggtgttcctaacatagtagaggggtgaaagagttagacaggaaagagaaggaagcaattaattggtttgttctctagctgtgggttaccattggtggataaggcatttaatccctacctctaggactctgagagccaacactgaacaataggcttcaattatcccactcaagggctgagagagttggcacatttatgcattttattagtttcttagagttcctgtaacaaaccaccacaaatgtgatggcttaatgcaaatttattatgcaacagttctggaagtcagaagtccaaaatgggtcgtactgggacaaattcaaggtgacagcagagctgcatctgaaggctccatgggagaatgtttccttgtctcttcctcttcagcttttagaggccatttgcctccctttgcaaatagaaggtgtgtcccctttatcttcaaagccagcatcagagtatcttcaaatttctctctgactatgacctccttcttccacttttaaggaagaatccataggataagattgagcccatctggaaaatccctcagcccttgagtgggataactgaagtgtatgtttaatgttggctctcagagtcctggaggtggggattaagtgccttatccaacaatggtaatccacagctagaaaacaaactaattagtagcttccttctctttcctgtctaatcttttcaccccctattatgtcaggaacacctccaaataaactacttacactcaagtccttgaattggggatagtttctgggggaacccagtctaaaatgaaacttgatatgagtttcgtgagagactgatggaggtacgtgctcaaattcttcaagtttggattgaagaagaagagttttatatttatcataagcttccatctcaagatcatcacttaatcacatctggaaagtatctttgccatgtgaggcaacttatttagattttggggattaggctgtggacatctttgggtgggcctttactctgtcaactgcatacatctcctctcatcagtcattagttgaagaccgattccaaggatagcactagcacttcatcctgctactcgggtaagtcaagcaggctctggtagtcagggaaagctcacaggaaaagaaatgcaggtgccagcaacaggaaattaggaagtgtgcagcaaagtgagaaggtgagggatagagatggggatcagccaccatctgctgcaaaaggcacaaacactttttttctttttttttttagcttttgttttgttttaagagaggaaggaagggagacaggacaaaaatcacagggcctatgcaaagttaatgtttatatacaagaaaaggttatataagtgtggaagggagatgcagagttcaacaagcaagccactgtattttttaactctatagtaaaagagaaacacaactctgaagaatcaaaaaactttcccccttggaaagcgatgtattaaaagaaacagaaaatattttagaaaatgttcatgttcttaatgtgattcaatagttcactgttccttttgagaagatgatggtggcagcagcatagtttttaaatctttccaaatactcacatccaaataaatagggtaactatataacaaaaccaaaaactcatgaataatttttacaaaaaaaaaaacaggtaatgaagtatatcacagagcacaatatacaagtagatgaagacaaattaccaacaggcataaatctgcatacaacaacttctgtgcaagaggaagtagagggatgcaatgggacatctgacagagatgagaacaagagaaccctcaaaatagctaagaggaactcactgcagcacacagtgggccaaatgggttcagcagctgaacctgggaggggtattccagcctccataaattttcaaaactaagccaccatggcttcctcccagggagccaacactgtatagaaattgctgggagtggcatcaaaatagaaaagaaagaatagtaataataaagatgaagaaaagaaaaggttactaaaaggtagaaagaaaaacagttcaaaaagcaagctactatatttttttaactctctaaagagaaaaagcaaaacagaaaatagagccctctcaaagtagaaaaactaccctgtgtcattcctccttctaaaagtttggaaaaaaaaaactaagaaacaggaaagtggtgaggtcaaatcccatacgaagttattaaaagaaaagagaataaagaacagaataattttcctacaaacaatgaaagcatgccaaaaagacatgtccacagaatagattcttaaattaagtaacacaagatatgaaagaacaacataagttggaatccaaaaaactcaaaacgaggcaacaattcagaaaagaattagaaataaagaaactcattttagaaacaaaggctaaacaataaggaacacaagaatgactcaactcaacagataatgcctttataaaaagagaaggtgaaaataagacttttaaaaatgcacaataaattaatagataaaaaggattgaaagtaacgaatattgaaagtaggccaagaagatttaatatatggttaacagaaactccttatgaagaaaatcaaagcaggagaatactaacaagtataattttttaaaaagcctcgaataaaaaaataatgttctcctaagaccactatgtgtgtaatgtggaacaaagtaattgtggaatcatctacttctaccaattgctatgtctttgagaattataattctccagttctccatgtaaagaaaggaaatacagataaaatataaagttaggtcaaagactctggagagttggatagaattggagaccattaggctaagtgaagtaactcaggaatggaaaaccaaacatcatatgttctcactcataattgggagataagctgtgaggatgcaacaacaaaggaatgatacaatggtctttggggactctgggaaaagggtgggtggggcatgaggaataaaaggctatacattgggtacagtgtacactgcttcggtgatgcgtgcacccaaatctcacagatcaccactaaagaacttattcatgtaaccaagcaccacctcgtccccaaaaacgtattgaaattaaaaaaatagccatttaacactgactagtttcctaatatctatatccagctgaaccaccctgggtaatgaaaaatgtctatgtgttccttctatatctgccctgattcttctgacttcagggaaagaaaagaggtagtacaaaaaccaagtagtagtagtagaaccaccttctaaagaggacccaaacaagacaacaattgtccaaggatgacaaaaggttttagggcagccatagtcaaagacacaattgacaaggaaatttgttacctctgtggcatacgacaatttagcataacaattataactgttactgataatgtataccaagtcatatcagaattataggagtttcccatgatcttggaacacatatcaataacacagttatacaactacagcccaaacgaaaccaatcaccatttcatatttgacaacgcttcctgtgtaatttttatactaaatatgccaaattatgtcatttttggattctagggaacctaatatcttaaaggattaattaggtcagaaaaatacataattttaaatttgattttggaaagtctgtcaaatattaaaggtttaaaacacttgatatcacaggtcattgtaaaataagtcattcatttgaccaaagtgataactcaaggatttcaaaaaaaaaaaggtaagaacctttattctttgggagaggagacttaattttcaaaacaataaaccctaatgaaacagcatgaagcctattaaacttgtttttcaaaattttatcaacagtctataaaagtttaatcttgaccataagatataacttccataagccttttataagctttataacatttattaaggagtcagttaatgcttcaagaaaaccttgttaatctgactcaagagcccatatgctggtcttgcatcagtgtgcctttgacattaatgattaacttatagagaaactgaacttattttatctctcaaaattggccattacaatcttacatccctacctcttctgtgatagtcccagggcctcaaggagttgaatagctttaatttctggccctgtgtttcaggaatacagtttattttgattggcatcttctactgggtgtgaaaatgaggctttcattttggtcagtgtttaagatttagcaggacttggtgtcctttttagacccaggagtcaaagccctgtaactcaatgtcacaaggactttaaaagcacatacagaaagatacatgaatgtaataaccttaattaaaattttttgtttcattcttcatcctaagcacaccaaaacttaataataatggcataggaatagtttttataaaccataaaatctggtagtccagttaccaaaaggcaaaagaaaagaccttctgccctccacagaacattatgttggaagaaaacatttcctttagatctttcagaaaacattgttagcatcaggccacaacaaacagaactcaaggtaacaaatttatatgaactgaaaatgagttgaaggggagtattactattttgcatcctttaaaagggaagagaaaactgaaaatggtgagatgcaataaaagttgaactttgagtttaaaaaattaaaatatattataatttgttaagagtaaaacaatcccttggctgggtgtggtggctcacacctgtaattccagcactttgggaggccgaggcgggcggatcatgaggtcaggagatcgagaccatcctggctgacatggtgaaaccccgtctctactaaaaatacaaaaaattagcaggtgtggtggcaggcgcctgtagtcccagctactcgggaggctgaggcaggagaattgcttgaaactgggaggtggaggttgcagtgagtggagatcgcgccactgcactccagcctgggtgacagagtgagactccttaaaaaaaaaaaaagaaagagtaaaacaatcccttaagaaaatttcattgttctaaccaaatatttagtgtgtaagtgtttttttcttacatcaagcctaatctctagaaagaccattacaatttccctttaattatagacaactttaacatataaaagttttttgtaatatataaattctcttattgtgacttacacagactgttcatgacatgtttggactttctggtttgtgctgaacatcccttttctttaaacaacctgtcattttattctaggactaaacttaccataaatgattctttctcatataaaattatgtctctttaagctttcttacaggaaaaaaaaaacctctttatttttaaaactttcttcatatctatttcctggttccttttgccttgttttatacataacctttaaataagctttgaattagacaaaaatttttcaccttttaaaaaatgacacacttttgattttacaaagaatgctttcctacaatatattattggaaaatacccaaataatggaatatctattatttaatataactttagattctaaattataatgagtttgtctacaagtatttatcccattacatttgcccaattattttattttaatcatttacctagattgtttatggaaattgcaatagtcattatttaaagttatggaactgccattgcaaaattataactggggcagtaaaaaagatctgacctaactgactccaccttgcttctaacctccaacctgtccttgtttattcctgtgcataggccaaactaactttggg

SEQ ID NO: 278 - DNA, 8875 bp, Homo sapiens
  2nd Enhancer of BTLA
ttattttctaaagttagttttaaaacaacattaaaaaaatttcaattgtaaaaatattaatcaatctaacattttatgcatgaaataaagttgccaagccgaagattttatatatcacagtttgtatccttttcactgttttaaattttaaacacaaataaaaattcaagaagtttgcaccaaatgacaaaaatgaaacagctcctgttctgcttctttgtctcagcattctctgtggtattattgtttatttaaaattgaatgttgaaaggctggagtatgtagtaccacagagatgaggacacaaagtgtccttggaggaaactggagtgatcctggactttataaatttgctatcaaaatgaacacaagtagctgaatggtatatgtccaaggccagctgtataactgggaagttctctgagttaacttgcaagtagaatgcaatgtttgtcaaatgatatatactacaaatgtgctaatttgaagtttacatatatatcataaaactcaacagtaaccatagtatttagaacttagaccaaaaatattttgaagggtaaatatttcacctctgacattgttcatgtttgctagtatgtggtgataattaaaaggaaaccggccgggcgtggtgactcatgcctgtaatcccagcactttgggaggccagggcgggcggatcaccagaggtcgggagtttgagaccagcctaaccaacatggagaaaccctgtctctattaaaaaatacaaaattagctgggtatggtggcgcatgcctgtaatcccagctactcaggaggctgaggcaggagaatagcttgaacccaggaggcggaggttgcggtgagctgagatcgtgccattgcactccagcctgggcaacaagagcgaaaatctgtgtcaaaaaaaaaaaaaggaaatcaacttttagttgtttttaaattcaatacagacaatggagccacttgttcacacccaggagtctggatatcccactgtccttgacacattagtaacgagacagtttctagcacaaagaagaggctgaaagtcttacaccacttttcaattttgccattagatttttgttgtattattttggatatgatataatctctcagagctttcagatccctcaagaggaagacagtctttctggctgggtcaatcaggaaaggcttcatgggggaagataaatctctttcttcctccaagccaacccccaggcaaatttggtcctcctctcattatcacagtataataccatcatctacctaatcacattagccagaacctggggagccatcttagtctccttccttgtcaccgtcccattccatcagccatgaagttcaattgattcaggatggaaaatgtcttccatatttgtttccatgacactgccttaatttggatctcattctgtttcatgtggattattgtcacagcgtaccaaatggtcttctacattccaaacttggccttgtttccctccctccacctcaattctccacatcactgtcacagtttccgttttcttttttctttttttttttttttttgagacagagtctcgctctgtcgcccaggctggagtgcagtggcgcaatctccgctcactgcaagcctcccgggttcacgccattctcctgcctcagcctcctgagtagctgggactataggtgcccaccaccacgcccggctaattttttgtatttttagtagagacggggttttacccggttaaccaggatggtctcgatctcctgacctcgtgatccgcccgcctcgggctcccaaagtgctgggattacaggcgtgagccaccgcactgggcctagcccagtaagtttatgcaaacttaccataccctcatatccccactccctagcaaatgtctgatgctattttgtgtgagatgcatcactccttttttgttgttgttgttgagacggagtctcgctctgtcacccaggctggagtgcagtggcgcgatcttagctcactgcaacctccacccaccgggttcaagcaattctgctgcctcagcctctggagcagctgggaatacaggcacctgccactgcgcccggggaatttttatatttttagtagagatggggattcaccatgttggccaggctggtcttgaactcctgaccttgtgatccacccgccttggcctcccaaagtgctagtattacaggcatgagccaccgcacccagccgacatgcatcactctttataactacatatgtgttcatgtttctgtcttctatctagtctgctacttccttgatggtgtgttacctttctatgtagtactggttgcacagcagagacagctaagcccttagagaggtgggctaaaaggcactgaggtgaagaacatatgcagctcaacataccttacagtggttaagttataactaccaaagaaaagctagactttacaagtattcagtttgaaaaggcctgatttatgtccactcaggggtggatattaaaaatatttaacaagtgacactccatggccatccagctacacagatcagctgatcagaaaggagtgccagccacaaacaactgtatagtctcgtaactcccagctgagcaagtgtagttgctgagctgaagagagtaggtaatttttgaaaccaatcagccatttaaaaaaaaagagggttatgattatgaatattttataaaatatcattatttcttatttttaaataccatatgttttgattataaccattatcatgaggaaaatctcacctgagtttcactatgtctccattgaaaaattcttacaaatttatggaaacttcaaagtggttgcaaccattcaaataaatgaatgactgtaatgaatgcagattgccttaacttgagctaagaaagtgtcagagtttaacatagaaattaaacaaatgattttttgagaaactaaaatgattactaacggtataataaaccaataattttctgtgacatcaaccaggattttagcttctatcagaaaatactatcacagacaaacaacaagcaaaccaaaacttcagacgcatgctggggaggctacagaaggaatgaagtctttacactcaggagcaaaaaggcatccagatggtatgttctgccttactttagaaggctggaatggtagagaggaggggagagatgatggccaccagggaagggaaataatctgtctctcaaatcttcccttgaaattagagtttagggatcccataaggcagtggtttgtacatagtcagggcaaatccacacacagcaatagcagccatggaaccatacttcaaggatcttgggaggacattgacttgcataccttgggaaatcacacggacgacatcagaaaacccaggtagcatactttcccatcataaactagctcacatacactcacaaaatcagaaatgtggtgacatgaggttagggtgggggagttccacctcatatagaaagtattcatttaatgtattatgtaatgtctattaaaggtattactttaactctgtggtaaataaaccactccataagtcagatattctcagaagtactaggaatacctggagaaaattaagtaagtatgacacacacaaacatatgttaaaatcagagcttcttttgtaaaagtgactattgttactttaaggaaaaccctgtgattgttctcacgagtacagtgaaaactgactggccctcagtcccttctgtaaaatgaaagtttatttacatatgtctttcctgaaaaacaacactaaagatacagatcatagacaatacagatcacagacaaggatgtagtatgcaatagtagatttaacttattctctgtggatatcacctgatattgctctttagacaagaagagccattttctccctgggtaaacacacacacacacacacacacacacacacacacacaatgtaaaatttccttcacaaaaatggaactggaaagtattaatgccaagaatacacagggcataaatctacatttatgcccattatttaaaaaaaaaaagcaaccatgaaacaagaaaattgagagcattttcacaatcatcttttattattatttcctcttaaaaatccccttcttataaaaacatatcttcttatattcatttatgaaatttttctttaagtttactttcatatggtattagcacactttaaagcaatttcttctacagttagaatttctcattgttagtgtagtatgactatttggcaagtaaatttgaagactgatctcttcaatgcagttgtattgagccactgaagactttaagctctgtatctcttgattttatcatgtttgaaataattctgaacttgttttgtctaaaatcagtcattctagtatttgtcattgctttttccgacatttagcaaagcttacaaagtccccatgtcatttcctctccttgagatatttaagagtagaacaagaagagaaccttagaggtcatgaggtcagatgcccaatggaaagtttaagttacatttaggagatcacctctagaatcactgctacacattctttgccacttgcccacaggtacactccacctcacattatctatatactgtagacccaacctagatccatcttaacacgaggaaaaaaagaatatgactaatattttcaaagttcttattatgaggtaggcacttttagataccaaacatgtattgtttcatttgaccctcacaatgattttatgagggaattactattatggcctttatttttttaagttgaggaaactgggtattagagaatataagccacttgcccaagatcaccagctggtaggaggaagagtcaaggctaggactttaacccaggtgtggctaactccaaagcacaagctcttatccagtagggttgttgtgaaagcaaatgagaacatataggaaatattcttagcactatgcttggcacataacaacaacataaagtaccagatattattatgttttctgataggatgaatttagggaaatcacacagaagttgagtcattgtccagaggtgtaaagcctatgaatggtaaagacaagatggaaacacagaagactctgctgtgaaaaattacccccaacaaccattctagggatcagcagtggtgcataataactagtatatacaccaggcaaaaatatatctatataatagagagaagaaaggcagcacatccaatataagcatgctcttcttttatgtgggagaggaaactctacagaaatatattaaccagcaaggcttgccttggtcaaaactagaatattgaaaaaaactttgtcctttgataattttctaagcttgctttcaggacttcttcattacatctctgccaagtcacaaatgtccccttgcagatctaccctactggtcactgactttgcttctctaggccagaggattcatatgcattgcactccttagagccctgtctactctgtgtaacaaggatgagtttctggtggttttagttggtcaacatgtaattatcgcccttgaatagtaaaagcttctagtcaacttaatgagtcctaaagaacaatgatttagagagactttgattgcctgttacacataggccctgtccttcagagaggctaaattttccacctttgtcacagggatttcaggaagaaacatagggcagcaaatgtagacagcatacctgagaagctgttgacagtagcatcagtgagtgcctctggcatttgatcagaaaccaacatgagtatttctaaatattgacttcagtggaaggattgttacttgtgatgttcagattaagtgtggcttatgtattatgattggaaagggaaagtccatctctactttcttcccagatacttcctcacatctctaatacattctaccacagacatcacactgagattcactggcattttcaaagcccttgaagatactaaacaatacttatgtggacagaatctgctaaatgtcttccaatattaattctcatcttctaatattatagaggaaaatgaagtggggccataaccccccagataaaaatctcaatgccccagcctcccttgtagccaaatactggataataggccatttgtgatgtgtgtgagttccaggttgtgcttataagatgaacatggttatcaagaaggcagaaaaaagaaattaaagagctctgccagctaaacttgatgttttcctgggactgatctaacactcttctggactctgttctaagtgaatctcaaattgtatgacacctctgcatgcatacacacagacacatgctgcacacaagccacttcttccattgagataaacatgtaaatcaggtccataaccatgagagtataccagaaaggtacaaaatattgagcttattttgaggtaagagaatggagagtattagaaaagtgaagcaaatcgcatatgatacaattcactgacacaatacaactcaagcgcatgattctcaagcactattagcttttcttggtgaccaaggataagagtagataatgcttttggcatttttctcacaaagtcttcatgacataaatgccaaaagcaattgcaacaaactgaagaacttctgcacagcaaaagaaactctcatcagagcaaaaaggcaacctacagaatgggagaaaatttttgcaatctacccatctgaaaaaggcctaatatccagaatttacaagaaacttaaataagtttacaagaaaaaaacaaacaaccgcatcaaaaagtgggcaaaggatatgaacacacagttctctctgtttttttttggagacagagtctcactctgttacccagctggagtgcagtggtgcaacctggctcactgcaacttcagtctcctgggttcaagcaattctgcctcagcctcccaagtagctggtcttacaggcgtgtcccaccacgcccagctaatttttgtatttttagtacagacagggtttcactatgctggccagactgctcttgaactcctgacctcaaatgacccgccctcctcagcttcctgaagtgctgggattacaggcgagagccactacacccagcctaaacagacacttctcaaaagaagacactggctgggcgcggtggctcacgcctgtaatcccagcactttgggaggccgagacaggtggatcatgaggtcaggagatcaagaccatcctgactaacacggtgaaaccttctgtactaaaaatacaaaaaattagccaggcgtggtggcagccgcctgtagtcccagctactcgggaggctgagttaggagaatggcatgagcccgggaggcagagcttgcagtgagcggagattgcgccactgcactccagcctgggcgacagagcgacactctatctcaaaaaaaaaaagaagacatttatgccaccaacaaacataagaataaaagctcaacatcactgatggtcagagaaatgtaaatcaaaaccacaaggagataacatctcacgccagtcagaatggtgattattaaaaagtcaggaaacaataggtgctggcaagtctgtggagaattaggaatgcttttacacggttggtgggagtgtaaattagttcaaccattgtggaagacagtatggcaattcctcgatctagaaccagaaataccatttgacccagcaatcccgttactgggtatatactcaaaggaatataaatcattctactataaagacacatgcacacgtatgtttattgcagcactatttacaatagcaaagacacggaaccaacccaaatgcccatcaatgatagactggaaaaagaaaatatggtacatatacaccgtggaatactatgcagccataaaaaagaatgagatcatgccctttgcagggacatggatgaagctggaagccatcatcctaagcaaactaacacaggaacagaaaaccaaacactgcatgttctcactcataagtggaagttgaaaatgagaatatatggacacagagaggggaataacacaaaccagagcctgttggggagtagggggagaggagagggaacttagaggatgggtcaataggttaagcaaaccatcatggcacacgtatacctatgtaacaaacctgtacatttctgcacatgtatcctgttttccttttttagaagaaataaagaaaaaaaagagtagataataatatcaagagtaatttatagaagacttttgtgaactccaaatttttatttgtggttgattcccaattgtcacccaatgttactttaacaggactattaaactaatgaaatgttggactaaaagaaaaaaaattagctaaatatacacagcactgaatggcatgccatgcactattctaagtgttttacagaattaattcacttaatagtcacaacaaccttataagattattctcccatttttttagatgagaaaactgagaaccagagattttatagtcacaaaaccattaaatggcagacataggatactaatccatggagtctggctttagagtccctgatcttagccactataccacacagcttctccaaggaaaaaagaaaatgattattttttggacctgattacaaatgcctgtaaatatttttcttttaacaattctgaactctacataaagatgaaactcacaaataatggaaattaagtaggaaagtcccaatgaggcaagataaatagttttgacgtcaactttacaatagaggaaactttggtagtaggacagaggaagcaagaaatttaaaaacttctctgtgataggaaaagtatattcaaggctgcaatgagcacaaggttaatcttt

SEQ ID NO: 279 - DNA, 26993 bp, Homo sapiens
  2nd Promoter of BTLA
gttctcatgttctcaggtttagcaaaacttctataaaatagtactgtgctctctcacttgtcatttttactttgtggcctttcctgtttctgcctaaaatagaactttctaaattagtctatcctataaatgtgacttggagtcctaccacacctgactttgggtggggaaagatgggttcataaaggttaagtggaacacaagattcacaaacatcaaagtgcatactgattatctgaagatcttgctaaaatgtcgatacttatttagcatgtgaaggctgagattctacatactaacaagctcccaaaggattcccatgttactgatttgagggccatcttttgagtatcaagagagtagatgactcactttgcaaacacagtcattcattaattaaacattatttaatcataatatgcgccaaacactgagctaaaaaactgaggaagaatgtgacatagtccttgctcataagaagcccacagtctaatattataggaaacataataagaaataagtgctatgaattatactgagaggaagagaagccacatactgaaataaattgtttgccagtgggagctaaacaaatggcacacatggatgtaaagatggagaaaatagaccctggagactgtggagatagtggggaggagctgagggttgaaaaattcctactggatacaatgcccagtgttttggtgatgggtatactacaagcccaacactcaccattatacatgtaatacccatgtaacaaacatgcacatataccccttgaatctaaaatttaaaaaagaaaaaaaaaaagactacatgcaatctagaaaaagagacatatttgataaaggttgttatcaaaactatacagagaactcttaaaattcaacaagaaaatgaacaacccagttaaacaatgggcaaaagatctgaacagacacctcactaaagaggatacatggattacaaataactatatgaaaagatgcacaacagtgtatgtcattagggaattccaaattaaaataatgagataccactacacacctattcgaatggcaaaattccaaaacactgacaacactaaatgctggttaggatgtgaaataacagtaagtctcatttattgccggtgaaaatacaaaatggtacagttactttggaagatattttgacaatttcttacaaaactcaacatactcttaccatacaatccagccatcatcctccttggtatttacccaaaggagttgaaaattgaaatgtgagtcataaccataacaatgctgtctcacacctgtcagaatggctactattaaaaagtcaaaaaataagacactggtgaggttgcgaagaaaagggaacacttatacactgttggtgagagtgtaaattagtttaaccattgtggaaagcagtgtggcaattcctcaaagagctgaaaacagaactaccatttgacccagcaatcccattactgggtatatatccaaaggaatataaattgttctgttttaaagacaaatacatgcttatgttcactgtagcactactcacaatagcaaagcatggaatcaaccaaatgtccattaatggaagactggataaagaaaatgtggtacatatacaccatgaaacactatgcagccatgaaaaagaatgagatcatgtccttttcaggaacatcgatggaactagaagccattacccttagcaaactaaagactattgcatgttctcacttataagtgggagctaaatggccgggcgcagtggctcaagcctgtaatcccagcactttgggaggccaaggtgggcggatcacaaggtcaggagatcgagaccatcctggctaacagggtgaaaccccgtctctactaaaaaatacaaaaaaaaattagaaaattagccaagcgtggtggcgggtgcctgtagtcccagctactcgggaggctgaggcaggagaatggcgtgaacccgggaggcagagcttgcagtgagccgagatcacgccactgcactccagcctgggggacagagcgagactccgtctcaaaaaaaaaaataaaaaattaaaaaaaaaataagtgggagctaaatgatgagaacacatggaaatatagaggggaacaacagacattaaggcccactagagggtggagagtgggaggagggagaagatcagataaaataactaatgggtactaataggcttaatacttgggtgataaaataatctatacaacaaactttccatgacactggtttacctgtataacaaatctgcccatgtacccctgaatttcaaattgaagtttttctaaaaccctgcacacaaatgtttagagcagttttattcataattgtcaaaacttggaagcaacaaaaatgtccttcagtagatgaacagataaactgtggtacattctgacagtggaatattattcaccattaaaaagaaatgaactatcaagccatgataagacatgggggaaacttaaatgcatattactaagtgaaagaagcaaatctgaaaaggctacatggggcatgatgccaactgtacggcactctggaaaaggcaaagcaatagaggcagtggttgtcaggggcttggagggagtgataaatgagtagagcacagaggatttttaggacagtgaaactattctgtaaatcactataatggtggatacaagtcattatacatgtcaaaacccaaagaactgcaagtgtgaaccctcatgtaacccatgaactttggttgataatgacatgtcaattctagttactgattgtaacaaaggcaccactgaagtacaggatgttgatgatgggagaaactgtgcatgtgtgggggaagacggtatagaaactctcaatgctcaccgcttagctttgctgaacctaaaagtgctctgaaaaaagtttatatatttagcaaaatagatatgatcgcgccagagaattcattctggggactagatagttttggttggtgcacaaaactgatcaaataaaccacatataccaaacctagcctctactagttttctcaaattgtggacactgggaaacatattaaaattggttggcatgtcttttaaagatgatgattaaagagccattttctagacctcctgaatcagaatttcttagtgctgcaagttaatagtctgcagtttagcaagttattcgggtcgcttttatgtgtcagggggtttaagaatcagtattctattcatgtccacacattttggggtacaaaatcagatgccaaattgatttcaaataagttttaataactttaccttctcattgagcacaatcacaagcttaaaatttgtgaaaaaccattaaattatctacatattctttttctcaaaccctctataaactaatgaaataagccatgtaaataatagtgaagtagagtcatttgggaaaatgcatgtatgtctctgacaccattttgaaaaggaataaaaacataaatgatttgtgattttggcaaacagtacaaatatattaatacatcttagagatgaaatcattatcagcattatctttactataagacatactaaggatattttaaataagacagaaatattttgcttttaagtttgagagaatcatgaaggaactgttcaatttcgtgtgttcatctgataagaggacagctaaatgtatcctccccatatttcctgtttctatttttaagaataccacaagcagctattctaacatgtctttcttacataagttgtccacaaatgcagcctggctaaaacagcctatctcgaattggttgcttgaaattctaggtgtaattggcaaaataacagtgactcaaaagaatatttgcacccccaaatctaaggagctaaaacttaatgccagtgttacttaagaaaatctctccaccacaaaacctcagttttgtctttttgtatatataccccacttgtattctaaactccataatttcacatattattttctttaatgacccatttactctagtattttgagcttcataagcaaactgaaaatataatgtcaatttgatcagtttctcgtgcaccatttctgttgtcacccaccccacctaacacacacacacacacacacacacacacacatcacattcctttgtgcagcagctcagctcacatatttgttgaaatggattttaacctttgctatccactttgtatgaagactattacattattcagtagcagcacctgagaattcgaatagcctcaaactgttgaataaaattataggctatttttgaaatagtttaactcaagtactttggaaagtccaaaaatctgaatccatcttttgctatactcttaagtggctgcaacctcagtattttaaaataaatgattagcaaactaaaatatgtcactacagatgatttgccctgattccttagtaagaagaacagcaagatgcagatgtggtgaatgaaagcaaattgacccctacagaccaattaaatattctgggttttcctccattccattaattgcactttaacttgctatcaagtcaagcatgaagcagtttaagctatcttcacttgcccagtgatacctattctgactaacttttaaactattcagatgcccataagtatattaattcagcagcattatgtcacattcctatccattagtctatgtgacccagtgagtctctactttcctcataaatgtgctatacgttgactgctccattaatacctatatttgcttatcaatctaacagagtagatataagcatttgtttgccaggtatgtggaacatctaccctatatccaattggtatattctatatttttattgcaccatttattattttcattttcttacatcaagcctaaaatgatttctcctttgcatttaagaaacaccattcttagactgacacagcaaaaatttcttattttggaagactgacttgaaatatacaatcattactgtatttatggttggttagtcaaattgggacattttgttttcaagagtgtgtagtgaactgatgcaggtaacacaaacctcttttccctacaagtctttccaatagcttcaaaggcaagatcgagtttgtatattgggtaaaatgtagctaagtttaaacgttctactattctgctactcatgatgtcaaccagttttggagagattttgttattcaaggctataatataaaaagctcccaaataagtttctgagagaaattttaatcatttatcctatggacccttaagacccaagcactaacatgaacatttctaaagtaaaaattctcaaattgagaaatattatttgacatcctgttgagcccagacaatgatgtcaacatgctgatcattcaatggtccctgttggagtcagaaacagacttaactcctcacacatatggatgcatattctgttggtgcttcttttacatttcttgccagtcttgagttcggtccaatgacagaatggttcagggaagcataaacaatgcctggtttgttttcttccaggcatggattagaataaacttcagacccttcctgcatcctgaaacaaaggtcagggtcattatcataaattccagtttctgatagcagtacttgggaattttgcctggtgcttgcttctgtttgctcactcttaaggtgagcatcaacctacaatagaaaaaaagatggttttaagtgacacttacggccatggtagtgcatattcattagcaaactatgaatgaaaagcttaaatggagtcatgtccattgtgagaaataatctactgttcctcacatactctgctgacatctacactttcagctaaatttcaattattaaaggatgaaaggcttgagaatcactatgtcacccctaaatagttattttgtgctttattactggtcacttttgaggtcacagaacattttttaatcccccttcaagataaaaagcatagcccaaattgatggaaaaagcaaaaaatatcctatgaaaacttcaggcagtttataacatgatgaatagtatttaatgcagtttagaataaaaagattaaggataaagcagaacaaataccccctaagagggcagaaacaataaatattatgagttagccaagatatattattataatttgagaccttaaattaaaaaattgatgtcagttttggaaagataaagcttagaaaaagttccaaaacagtattccagttgttattcctatcaaaagaaaattcttcttttttttttttttttttgagacggagtcttgcctatagcccaggctggagtgcagtggtgcgatctcggctcaccgcaagctccgcctcccggcttcacgccattctcctgcctcagcctcccgagtagctgggactacaggcgcccgccacctcgcccggctaatttttttttgtatttttagtagagacggggtttcaccattttagccaggatggtctcgatctcctgacctcgtgatccgcccgcctcggcctcccaaagtgcgaggattatagacgtgagccaccactcccggcaagaaaattcttaccgtttcaaatatagccaaatatcttagagcttctaagaaagaggtgaatttgtaaaaacaaaaagtaaaattagtcctgatgttttctcactcttcagttatttattagccgctcctacctatacaaaggttcacctgacaaagaagatgtgttcattctaggggctatttcagttttttaaattcaagttttgcccatcgatttccgttcttgacatctggcctaactcctttaaggtatcaagtccactgtctttgaaagtcaacatactttgtctggtcctttgtcatcctcattgtgatgtgtgcagtaggatgtctatggcagatttccttggcagagctctatcatgcaagcatgtctggctttaccctgagaagctatgtaagaattcctgatacagtgccaccctctgatgtggtggctgcccaaaaataacagtaaggctgagcgactgaaagaggcagaggctgcttggctaagataaaaagtactcccaactccactgaaaagagcctggttgaggtcagtaggtggcacactaaagaagactgtcaagtgaactgaaaaatagcctttagtcctcaatatatcaacaaagatcctgtgatacttttcaatctgtttaagcctgtcaattgggttccctgtctctcatcccaagaaatggctcatttccatgaaaaattttgttaaaatgaatggagcaaaagaaaatatagtgctctgcagcacccctgctgtggcaccccgtcaaagtggctgggtgccacaaggccaatgcaccacaatgtggtggatagagatgataaagccagaaacagcaatcccaccttacattcctatggcaggttacagtatacaaagcattttaaaatttgtatttatagtatatgtttagatgtaattcacatgccataaaattcacccttttaagtgtacaattcagtggtttttattaggcaagcactttataccctcaaaggaccgttttggattaagatcagagctttggcttttatatgtacctgttacatttgtaccagttcctttcctgtcatgtttataccagttcctttctgtactttgatttctccacagttcccaaactagttttatgttaagaaatatttagccccaagggtataatatggtatccttttgattattttctgaaatgctagacaactgaaatggggcaaaaatcttcaaattcctgttaatagcaaaaacgctttaaaacaaacttcccagacaattgcacatacagaaaatacccttttgaattaagcttcaaatcataatttatccagcctacccaggaagaacaatgtccacagcttaaccaacctgggttttacttgcacagtaaattatttagatttttatcttaaataatttcatagctccctggccttattgtaatcaagtgaaatttttattattatttactatagaaagaaaataatatttaagaaaatttccctatttgagggaacaaagccttagcaccctacacagtgcctactgatgctaatgaaaacttaatagaagtttgtcaagttgagtgtatttggtctggtttaaaattaagcagcttggtggggaatgttgaatgccatttaatattatatatagaattattggctgtatcgattttgtcttttgtggaatttttaagagggttactacttctttatcactattcctccttattgaaacacacacacacatcaagttcctttgcagtatctcatttatgactgtttagttttaattagagagcttcagaatgcttttccacaaatatattgcctcatcttgcattcttttttagttctaatatctccacaacattcaactcaaaagaaaagcctacatttacattccaaaccttataggaaagattgactccaaaattcccttcctttagtctgagtggtcccttccttgatgagcccatacacattgccagggacctctgtgtaataactaagccaaagatcatgtctctattttgctggtgctatttatgaagatatctaatcattttatgaggttatttgtgggttcattctttcatcagctccctactctcttccagaaagaccttaaggtgtttacataaaaaataaatgaatagcctgaagccacataacaggcaagagcagagtcaagtttgtatggttcagtctctgacttttctgtcttggatctagactgccttccatgaacttccaaagaaccacttattacgagacttgttaaccctaaagagtctttgctgcatagagagcagaatgcaaaattcacatttttaaaaatgggtctatgtatatatatatatatatatatatatatatatatatatatatagtacatagaataatgcctggcacatggtgttatataaattcattgaataaataaataaacacagtataacacaaattgcatttgtttcaacagctacatcaagcttaccaggttaatttcccttcctgctgtgtcagagagttcattttgctttcctggaagacaaaaagaaaaagaagtaatcaaaaggagtaaagaaagcagaagtaaaccaccttgccacccatgcttatcctgttgaatgccagggatagtgttgttagttttggcttgttaatttgctttgcctagcacacacttgtttgtgataattcacactgaccagctctctctctggttcatcacttttcagtccacatagccccatggcatatctaaaaggaaggggagggatctagtatatcacttggaagagactggaagtccttgctctggggacattccatactcaatgccagaaatgctgctgtcctgtcacctatgtagccaagatctcctactacctagttcactttggatgtggtaaatcaaaagatttatccctgactccttttctgaagttctgagagaggttccagcagtctcaagaaagatgatgaaagatacagagaggccatagaaagagccatggagttgcagatgaagaattggggtaagagagaattcttcagaatccagagaaggttctgaactccagaagttctcactccaaaataccagaagcacttttgcccagtcaaaggttattcctgtgtcacacagaataagtgttgctctatctagctcagtttctatagctacactgtagctggtgttgtgaaaacaggaatgtgagaggatggaggagaagaaaaaggaaagagaaaactgaagtagttcaggccaaagctagatcagaattctctatgctttcctctcttacttaacatatttggtcatgacattgagagagttcttgcaaaagtagaaaggaattattttcaaaatatcacaccattcccatcatagccaaacccacatttttcatatgcattattgttgggtaagaattcaggtcaagcatatgtttataatggcaatagaaaatacagacatattaattttctctggggacattggttcttcagttacataagggtgtgtgtgggattggcatgatgtggtgtggctgtgaaaagaggataatacaaaataaagcagatatcttgatctgagagattgtttcaacttccaatcctgttaaggtttagaagagctctttctcacacaaacctaagattgatgcaaagagaatgatgaagtctcagcaatgtgctatgctcgccacaactctagctggaatactgtgcgtggtgagcatgcctctcccgtgactcaagggagccccaaccaacctatttagctttttagcgcaaatatgagttgtcttctaggaaatcattatccatggtttacaggattgggaaagaaaacaacaggaagaaactaaaaatcctttagccccagaaataagaatggccccaaatgtgtggtactgggggcagagggaaaatagaacccaccttggtgccttctcaggcagcagaacaggcagaaacaggtagtgatgagtagaggcaatccccccaaaggaagtaaacgatacaggagccagggtctgcttgccatttcgtccttggagggtcgttctgaggcactttttacatctggaatgttagtaaatgctaaagagagttaggaaatctgagatatattgggatcagcggcacccctctgcattgtcagaacttgagtgaaggagatttcaggccaatgcctccatttccccttcagaggcattcctcaagaatcccagtgccctcagccacctcttgctttcttgctgagcagacgtggctctgcgataatttatcttttgcagaaattctttattctgatagagttaatcttccacagaacaatcttcatgataactgtcagaaggtacttcattaagcctttctatttacagtatctaactctcatattcatcacttaagtaggaaaaccattgtctttattttgtcccaagagttgctccaagtcagatagctagtgagtggcaatgggaactcaagccaacatgtttgtaacaggaaattcaagtttcttcaacacaatgtcctttccttgtctcgtaacttatcagaatctccaaatatcaaatacttttgatagccttaaaagtgctctgcatggcacacagctaatgcgcattactattgatcaatgttaatacgcattgaggccctgtttgtctgcagttgttcacagctcattagcaggttgtgaaacaatttagtatgtcacaaatagcattttaaaaaatgaaacagaagaggatagaaatcatcagaatgcatcacacacactagagcagtggttctcaagcagggaacatgtgtggcaatgtctggagacatttttggctgtaacaaggtagggggagggaggctggcaaccagtgagtagaagccggggattctgctaaacaccctacactatacaggatgcaacccccacttagtgcaacaaaacattatccagaccaaagtgtcaatggagaaactctgtcttatggttaagtatgaccttatgaaacttttttatatttgtgtgcattatgggttgtgatgtaagatctggttgttgttgttgttgttgttttttttaattttgggttacagttaacacagtatgaaaaatactggagtaagatattctaaggtctggcctggtggctcacacctgtaatctcagcactttgggaggccgaggtaggcggatcacttgagatcaggagttcgagaccagcatggccaaaatggtgaaaccccgtctctactaaaaatacaaaaattagctgggcgtggtatgcacctgtaatcccaggtacatgggaggctgagacaggagaatcgcttgaactcggtaggtggagacttcggtgaaccgagatggtaccactgcactcagcctgggtgacagagtaagactccatctcaaacaaaaaaaaaattctattaattatattataatgttattttgtttggctagatgcttaggtttggggtaaaaatgattagaggcaactgaagttgcacaaaaagtggtttggttattcagagtggtaacaaatgttgtctattgatgttgcagctgctgtttaggttagcgagcagccaaaccactgccaggagtgccagaaacagctgcctgggggagggtcttggatagcaatggggactaaggtttctacaacagataccctaatacaaacagatctgctggatcaagaagatccaacttctgttatttctttaaccaccaaaaaaacctaatttccttaattttacttgattagtttgatcaaataaaactaattcagaacaaactgtttctctatttcagaacaaactcaaaactccccctaacttattttgagtttgttctgaaatagagaaacaaggtaaataactgaaattgattgagaaaatgatgagggtgtactctcacgtgtccaaaaccagagctagccttggggaggattccagtgtttgcacactaccagagaatccaacaatctatctcaagatcagtaagcacaatttgtggaacatcaaccccacgatcattgacacaaagtaaatatctgggcttattttgaagctcactgaaagactgtaaatacaacgcaatctttgtctgtctgctttgatcacctcttccccattccttaagcataaggacacagtatagtctgcacaatgatatctctggcacctggaataagaagaggcacattcagcaggtgctccaaatcagggtggaagcccacaaggacttcctgccctctcactccacacccactttcctgccacagataatgatcacattttggggaagttctttttttcttcttctttttttttttttttttttttgagatggagtctcgctctatcacccaggctggagtgcagtggtgcaatctcggttcactgcagcctccacctcctgggttcaagtgattctcctgcttcagcctcctgagtagttgggattacaggcgcctcccaccgtgcccagtttattttttgtatttttagtagagatagggtttcaccatgttgaccaggctgatctcaaactcctgacctcaagtgatttgttcgtcttggcctcccaaagtgctaggattacagatgtgagccaccacgcccagccttggggaagttcttaatctgaaactgaccaagggaagtttgggaagggtgaagtggcaggccaatggatgtttcaagggctgttccccagctctgtcaacttttcccctaggactttggcttgttgtgcaaggtgcttttcttcattctgggagaatagtgctttcccaagagcatccaagccccaactctgtcacagtcctgttcttacatgaacttttaacttgaacataaacagcaaaagaaagtcacttataaaaacaagaaaatgtccaaaatcacttcggaaatatatttcacaggaaaaaataaaatattttttatcagacctccaaaatttctttatgaaaagcatggtccttaaacatatttccaaaatatatttttctcctcaccttatacttagttcactgagcactttcaggttcagaaggaaaaggaatttttctttgaccctccctgttatttttgttttcaccacttcactaaagaaaaatgcacacctagattaaattagttttaaatccacacagagtttaaattaaagttaattcctaaacaatttaccttttgtgaaggaagttaaaagaaaaaaaaaaaagaaatattacacaaattccagccttccaggacattataatctttcatgggacctaaaagacatttccacacattactacagtgaaaggaaatgataaatgagaggcacagacttaaatggcataaaaattggtaaaaaggagtgatcccttcccctcaggtgatcatgaaaagcttccttaagaacttggaaaattagctgagattgaaaggaggggtagaatttccataggtggagacagatgaatgggtgctctacaagtggcaagagcagcatacacagggcaatgatggagatgtggttatggcaagtaaggccgtcaggctgcaattgagaggctgtatatggaatccagaaacaatctagaaaggtggtgggatcaaactgtggaagactttgaatgctggttaacaaagatgagcccaatattgtgaccactggggatgctatgcaagagagtgttgttatgaaggaagtgtatgaggtaatttaagtgtatttggctgaaattgaccaaaatggggaaatactaaagacaaagagtccaatcatagaattaattggaattatttagaaggaagataatgatggtgcgagatgcttatagaagcaattggaggaaacacatcacagagtggaatgttgtggagagacaagagtaggaagccaaagaaaattctctgggattttccatgaggatcaagagcattaattaacaaactgataaggaagggagtgataggaaggataggtgagtaggaaactaagagagtagaaatgttcaaaaagaaactgacaaggcccttcatgtctcctatttagctcttagactttctctttcaccacttcatacttcacatactttgttccataaaaccccccaaggcacaggatttaggagggaatgttattccctttcccctaaagttgggttctttcctccacaaaatagatagattgttgatcctaatctcagccccaacttgatccctagaacaggcacctttatgcactttacaaactacagattatctttagtcatcatgaatgacccaaatatgggatagagcagaaattgcaatgctacttttgtgtaacagacttttgtatcacaattaattattaacttctgacctttcatctgaccttggctaaattcatgtctcgtatagaagtagattagttcccataaagaaagactgaattacacaaggcttctcttccaaggaaggtggactcaatgcctcaaaatttaattttattatacattatgttaatatattatataaattagttaatagcacttatttattcaatagtatatatcattctagaattaatattttgcagattttccttatttttgtaatttattttacctgtttaaaaaatagtatttgttaaaaattcaatattttgtctcattaatgtgaattaataatgcaattctttccagaaagtgttcattccatacatccttaatatagccttctccaggttgatgaagacaatttttgtgctttgcatatactatgttctttaattcatttacaaagaaatatttagtgagcccctaccatgtgccaggtaccctgccatccatcatacagagcaaagatgtttaagacacagcttccatcctgaagaggtttataagccagtgcatggatggtcacaagtaactagcaccgagcttcacgctatatttgcaaaagcagagtccctaactctgccatcgatttcttctatatttcataattgagggttgtagctactgctaaactgctatgcattttttcatggtgctgctgtaagaaattttaaactaacctaaagcattttaaaagaatttcaatggattccttcactgggctactttaagggagttgaaagacactcaaaagtaagcatataaagtaacaaattaattttaaaaagatcagttgtaaaatgtatgcattcaagtgaatgatgtccataaaggaactaaactgtacgaggttgcatccagagttcagccatgctgctattgcaataaccctcttttgaaatttctccttcccagtaactttaagggtcaatttatgagcaacaaaagaaactccacattatttcttataattaaagggcactcttctttgatccaaatatatttttattgtggtaaaatacatataacataaaagttaccaatttaatcatttaaaatgtacaattaaatggcatgtaagatactcacaatgttttgcaaacgtgactacgatctagattcagaacatatttatcaccccaaaaggaagccctctacctatttagtagtcatgtcacattctttatttcctcagcccctggcaaccaccaagctactttctgtctctatggatttgcctattttggatatttcatataatcagaatcacattgtatgtaacctttttcttcttttacttagcgtaatgcttctgaggttcatcaatgttgtagcatacattagtacttcattccttttcatgactgaataatattccgtgtgtggataaactacatttcctttatccattcatcagctgaacatttaggttgtttctaccttttggctattgtgaatagtgctgtgataaacattcaggaacaaggttttgtgtgaacatatattttaatttcatttgagtatttacctaggaatagaattactgggtactgtgacaagtaggttttatcttttgattttgaggaactgttagaccactttctaaagtgactgcaccattttacattctcctcagcaatggatagggtttctatttcttcacatccttgctaacacttattattttctgtgttttttttttttattctagtcattcgatgggtgtgaagtgggttttcactgtgactttgatttgcatttctccagtaactaatgacattgagcatttttttcatatgtttattggccatttgtatattttctttgatgaaatgtctattcaagtcctttgctcattttaaaattaggttgccagtctatttgttgttgaattttagtatcttttgatgcacagaagtgtttaatttttatgaagtccaatttatctatttttggtgttattgttgattatgcttttgtaatcatagctaagaaaacactgctaaatccaagatcagaaacatttatccctatgttttctcctaagaaatcagagttttattgttttatataatgcagtttttatagttttagctcttctacttaaatgtctgacttattttgattgcttaaaatatggagtgagatgagggttcaaattaattcttttacatatgaatatccaattatcctggcaccatttattgagactattctttccccactgaataatcttggtacccttatcaaaaatcaattgactacggatgtatggagtttattctggactctcaattctatttacattgatctctttgtctatccatgacaatactattctttttttttttttttaactgtcattttgtagtaagttttgaaatagggaagtcttagcttcagttttgttctttttcaagattgttttggcaattctgggtctgttgcaactcaatgtgaattttaggatcagcttttttatttctgcaatagcaacaaaaagctgttaggattttagtggaactgcattgaatctgtagatcaccttggggaatattgctatctttacaatattacatctttcagtccatgaatacagaatgtctttgcatttatttacatattcttgaatttctttcagccatgctttctttgttcagtgtacaactcttatacctctttggttaaatttgtacttaaatattttattcattttgatgctattgtaaatggaactgtttccttaattttctttgtggattgtttattgctagtgtatagaaatatcactgatttttgtgtgttgatcctgtatcatgtggaattgctaaattcatgtattagctttaatagttttaaacaaatttttaagaatttttctacacataagttcatgccatctgtgaataaagttttacttctttttttctaagttagatatcttttatttcttgttcttgcctgtttgctctggctagaattttcagtttaatgttaaatggaaatggcaaaagcaaggatccatgtcttgttcctgttcttagggggaaagctctaagcctttcaccattgaatatgatgttggctataaaatttttataaaccaagtattttttactcttacctactccccccctatgtattttttcatgttttattcagcttggtttccccaagcttaacttctatctgtccttcctcagttgtcaaagcatattaaaggcctctttcggggaacagggaagagagatgaagctctgaatattcccagaaaatcactaggaagtcagttagttgtttgctgtttttcctctaaacaaactgtgaactattaagaagtgtttaattgcctaagcaccacaaacataacttcaagaaattgtaatgaacaaaagtaaagaagagaaaaatgggaaaaagagaaaaaaaaaacaacaaagaaggacaagcaatcacagagctattcgcaactataggtattcactttataattttttcaatatttcagtggtctacttttggacttatcaaataaattttataatccctaaagtcaaaaacaataacttttactatctatttctctactctcctctatctcactcacctcaaacgcacacatacacacacatatgtacacactggcacataacaatctgtgaggtgtagcagatttcagatgtgctataggagttggctttctaacataatcacttgagaaactgaacccccctcttcctggaaacattataagaaaaatatcagatggtctaggtgttgagaactcacctgtcacataaagagttgttgagtggctttcaatgagattagactgaaaatttgcagaacagcggtatgacccattgtcattaggaagcactggttcaaaatgtagaatgaaaaatgaaatgttcttctcttccttccaacttgtttgtctatcttcaagttttacacatgttgttccattgagcttgcaccaagtcacatgaggcctgttagcacagtatttcacagggcattctagttcaaagggatctcctgctaagatggagtgttcagattgtctctttatataaagctgtacatcacatgattctttccctaaaagataaaaacaaaactaaaatcaaatatgttcttctggaagtaccatatatatgtgacttcaatagttctcaagcattatttggtaattttcaaaaacaaccccccaatttctagtaattaagccttactagcagaatgtctcatacatattaggcatataataaatatgtttaaaaaatgaaataaatcatttaatcctctgtctgtcaggcctttgagcccaagctaagccatcatataccctgtgacctgcacgtatacatccagatggcctgaagcaactgaagatccacaaaagaagtgaaaatagccttaactgatgacattccaccattgtgatttgtttcttccccaccctaactgatcaatgtactttgtaatctcccccacccttaagaagtttctttgtaattctccccacccttgagaatgtattttgtgagatccaccccctgcccccaaaacattgctcttaactccactgcctatcccaaaacctataagtactaatgataatctcaccatcatttgctgactctctttttggactcagcccgcctgcaaggtgaaataaacagccttgttgctcacacaaagcctgtttggtggtctctacacacggacacatgagacactgtcttagtctgttttctgctagtataacagaatacctgagattggataatttttgaatcacagaagttttatttggctcatggctctgtaggctgggaagtccaagagcatggtgccagcatctagcaaaggcctttgtgctgcattatctcatggcagaaagcagaaagtggaagggagcacacaagacagagaaaaatgggggccaaaatttatccttttatcaggtgcctactcccgtgataacgaatccattcctacaataagggcattaatacattcataacctctgatctcttaaaggttccacctcacaaaactgttacaatagcaataaaatttcaacatgaattttggagggggcattcaaaccatagcattctgcccctggtcccccaaaactcatgttcttttcacatacaaaatacattcattccatctcaatagccccaaaagttttaatttattgcagaatcaattcaaaacactaaattcagagtcttatctaaaccagatatgggtaagattcaaggcacgattcattatgaagcaaattccctccaactatgatcatgtaaatcaaaacaagttatctacttccaaaatatagtggtaggacagatataagatagatattcccattccaaaagggagaaataggcaaaaatgagaaagtaacagttcctaagtaagtccaaaacccaacagagaaataaaatggcattgctgggcttggttgatgcttcagcactcacaagttggagactcctacctgcagctctcccaggctaatgcttcaggctaatagctccacagttctggggtctcagtggcagtccactcccatggctctactaggcactgacatgggagtggactcttcctgggccctcaggctgtccacaacatcctttgaaatctacatggaggaagttgtgttccacacctcttgcattctgctagcctgcacacttagcaagtgggtgccaccaaggcttaccaattgcaccttatggagtggtgggttgaactgcacctgggctcacttgagccatggctggagcagctaaggagcactgtgctggaattcagagaacagaaacctgaggcagatctgggcagcaagcctgtaaagggcattctagtttcccctgaaatcaatttgccctctgagctctgagcctatgatgggaggggcagcctcaaaggctttgaaatgccttcagggcctttttctcaacttcttgaatagtacttcactcccttctatccatattaatctctttaacaatggtcactaggccacacccttagtattttctcccattcatgccttttcactttttatatggctaggcagtgaattttccaaatctttctattctgcttctcttttaattataaattccatttttaagtcatttttttccctcctgcctcttactgtatgcagttaaaagtagccacacagcagcctaaatgctttgcggcttagatatttcttccaccagatatcctgaattattgctcttaatttctgctttccgtaaagtcctaagacatagatacatttccaccaagttcttagcaactgtatgacaagaatggcctttactccagtttccaatggcttgtttctcatttccttttagttatgcacttggtgttgatttgtatttttttattttccagtaaagttaaggctaagcacgtgatcctaaaagtattttcttttaaattatttttttctccactcttacagttctttcttagcctttctttctatgttttgaactaccgtctctcttagcaatgtctagttcatctccttcatttatttatttcactcattttcatgcattcttctgaatagatgtacagtatcatacattagaatgacataagtgtaacagagatgatagccaaaactctcttttaaatacaaagacagctaaaggccttgcctgtgatcacacagcttgtcagatgttgaaccaaggagcaaattttgaccctgagtttctcatacatgtctatccagaacaaggtttcaccttatttctacacccttgccagcataaatattctcattttatctatttcctcacacctaatacacctttcactcacatcctacttaaaaacccttcctgctcacatctcatgaatctctgctcagaataatagaaacctgattgagtttccaggaatcagagtgagaaaaaggacctgcagacaacttttagaacctcttaatatttatttatttataattgctttgagacctcaagcaagttcactttaagacttcttaattcagttgcttccaaaagtttagaactaaaatgaaaccaaactgaaaggtaagttataaggatgaggttttcaaaaaaatgaagagaaagggtaaaatattttaccaaaaggaagtgtacctgaatgtggttagacttaggacaaaaaaagtaagaaggccagaggcagaaaggtcaagtgaaactcttgtttccagaagtccgttcctctccctgaagttaatagactccctcagcctcctaacttcccttttcattttcttggataagtcaataatggtttatggagcctctaagtctgtgctagaattataaaaaacaatgagatggttatagacaaagatcttttaccctcaaagagtttaccatttaattggtaagccccaggagtatctaacaaagagggcacctttcttttttttttttttttttttttttgagacaagagtttcactcttgttgcacaggctggaatgcaatggcatgatctcggctcaccgtaacctctgcctcccgggtttaagcgattctcctgcctcagcctcccgggtaactgggattacaggcgcccaccaccacgcccagctgattttgtatttttagtaaagacgggatttctttatgttggtcaggctggtcttgaactcccaacctgaggtgatcagctcatctcggcctcccaaagtgctgggattacaggcttgagccaccacacctggccagaatcaatttaccttctagacacttttctagaatcaatttactatataccagtctttatttctttcagtttactgagctgaaagcaagccttgagggacgttgcatgctggttgttaggaagcctaggaataaatcagataggatgtctgcatttgtggagcttgccttctaatgggaaataaaaatgaatggcaattgggagagtgttatataacactgtaaagaggtacaaacaaggccgggcatggtggctcacgcctgtaatcccagcactttgggaggccgagggaggtggatcacctgaggtcaggagtttaagaccagcctgaccaacatggtgaaacaccgtctttactaaaaatacaaaaattagccaggtgtggtggtgcgtgcctgtaatcccagctactcaagaggctgaggcaggagaattgcttgaacccaggaactggaggttccagtgagctgagatcatgccactgcactccagcctgggcaacacagtaagactctgtctcaaaaaaaaaaaaaaagatacaaacaactttgcatgggtctgcagaaggttaacttcagccggggcaaagcttcatggaaaggctatacttgagctgaaccttggtgaatgagtagccctttggcaatcagagcagtgcatgggacagaggaggtattttaagagtgaggaaatggaacggaaaagtcttagggaccaggaatctcatgatagatttagatcattgatacacaactggatcatggttttctgacttagtgatatggagaccactggttgtttcagaacaaatggaataagcattaggcaggagtttaaactttgcttatccaccatgagaaaatacaatgcctaattttggggggatatttataaagggcacggaaatagctacaaatgagactattcatttgaacatgtctgtttcaaatgctaacacattgagcgaatttgatagtcccccagttttgctggtcctcagtttcttcaaaataagatgaaaggattgaactgtaaaagtaggaaagttctaactcaccatcccctgaccacacaaacacacacaacttcaccttccttaatgtgtgactgaaactacgaaaccacttctagcctgcaatttctattcctatcacaatatattacctttctatttagccatagggctatcacttgatgttagtggcacaattagacatcacttcaagttctgtcttttgtgactgtatgctccggagcagtgcgcaaagtgggttaggggtggagaaaagagctagctttttgtgttggtggcatcactgattcacaataggattatggaaacattgcagttcctaaatattcttatcagcaggataatgatcattgacaaccacactgactggcacaggaatttttcttgaatggaggaatgaaccgatgatgaatgtaggcttgcaagcaggcattagaaatcaagagtactccctctgtgcacaaacaaggtattataatacctcctatctctcagaggctaacactgatgtttgtagtgtaaaaatgacacactgagacaaatagcacaattctattttttttaattaatttattttttttgagatgaagtctcgctcttgttgcccaggctggagtacagtgatgcaatttcggctcactgcagcctccgcctcccaggttcaagcgattctcctgcctcagcctccccggtggctgggattacaggcacccacaaccacgcccggctaatttttgtatttttagtagggacggggtttcgccatgttagccaggctgatctcgaactcctgacctcaggtgatccacccgcctctgcctcacaaagtgctgggattacaggagtgagccaccggcctggccgacaaatagcacaattctaattgtccatctgacaagcttgttaacaccccttttctgcctgttctgaattatgcatatccatcttatgatacttaggacacacaaagctatcccccaaaagtttgtcttatcaaataaatatttcccgaagaggaataactatcacagttgcttttggctgttactcaacttccaattatcagttatttgatttcattttttatttatgtattttttgagacggagttttgctcttgttgcccaggctggagtgcaatggagcgatctcggttcactgcaacctccatccccgggttcaagcgattctcctgcctcagcctcccaagtagccggaaccatcagttatttttattcctgctcttattatctctgctgtttttctcaagcattcatatctgatgacaggaaattttcaatgctaaaaatgattaaaataaatacatgcagtaaaagaataaaaacttctggccgggcacggtggctcacgcctgtggtcccagcactttgggaggccgaggcgagtggatcacgaggtcaggagatagagaccatcccggctaacacggtgaaaccccgtctctactaaaaatacaaaacaaaaaattagccgggcgtggtggcgggagcctgtagtcccagctgctcggcagactgaggcaggagaatggcgtgaacccgcgaggcggagcttccaatgagcctagatcgcgccactgcactccagcctgggtgacagagcgagagtccatctcaaaaaacaaaccaacaaacaaagaataaaaacttctactcccccccaggctcttatataatgaaatatcccttgttaagtcactataggtttagaaattctttcatgtttaaaatttttatcaaaaccactagtggtatatatattccacgatcaggtggtaccgatgatattttattttaggtctagagtacatcatttgagcaacccctttctctatacataaaaatattttcagaaataatcatgagataaaacaagtaataaaatggccagaaaagaaatatagacaatgaatattttcttgtgctgaacttcatgtataaaaccatacaaatgaaaaaatgttttaaaaaaattaaaatacaaaaaaagaaaaatgcacaggtatttattcaatcatttttatatccacctaaacagtatgaactttgattctttagttatagtctgatataatagtttatgtaaatagttgtccaataactaataaatggattgtattaaaactgaaattctgcaaagatacaatttaggtaactactaaattgtaacactaaagttttattttctaaagttagttttaaaacaacattaaaaaaatttcaattgtaaaaatattaatcaatctaacattttatgcatgaaataaagttgccaagccgaagattttatatatcacagtttgtatccttttcactgttttaaattttaaacacaaataaaaattcaagaagtttgcaccaaatgacaaaaatgaaacagctcctgttctgcttctttgtctcagcattctctgtggtattattgtttatttaaaattgaatgttgaaaggctggagtatgtagtaccacagagatgaggacacaaagtgtccttggaggaaactggagtgatcctggactttataaatttgctatcaaaatgaacacaagtagctgaatggtatatgtccaaggccagctgtataactgggaagttctctgagttaacttgcaagtagaatgcaatgtttgtcaaatgatatatactacaaatgtgctaatttgaagtttacatatatatcataaaactcaacagtaaccatagtatttagaacttagaccaaaaatattttgaagggtaaatatttcacctctgacattgttcatgtttgctagtatgtggtgataattaaaaggaaaccggccgggcgtggtgactcatgcctgtaatcccagcactttgggaggccagggcgggcggatcaccagaggtcgggagtttgagaccagcctaaccaacatggagaaaccctgtctctattaaaaaatacaaaattagctgggtatggtggcgcatgcctgtaatcccagctactcaggaggctgaggcaggagaatagcttgaacccaggaggcggaggttgcggtgagctgagatcgtgccattgcactccagcctgggcaacaagagcgaaaatctgtgtcaaaaaaaaaaaaaggaaatcaacttttagttgtttttaaattcaatacagacaatggagccacttgttcacacccaggagtctggatat

SEQ ID NO: 280 - DNA, 11899 bp, Homo sapiens
  3rd Enhancer of BTLA
tccaagaggaaaagtatgcttttagttgagattccagatgtagacaagagtcaagaaattgacatgtttagatatatgctgtttgaaattcagaattgcaaagataataagtgatttctacataggaagaacaaaaacagaaacaaaacaacagggtacctaagatgaaatatatatatctcttatttagaacagactttatgatgctcaattgcagaactaaataaaactagctacaacattttgaaagagagagaaaaaagttaccttatcatgtatatgtgaagacaatggaagtatattctcagatgtaaatgtactcaaaagatacatgactcacttaactcactggaaacaaagtaggggaacaaatactccagctgcctgataaaggaatctaaatcaatatccaagagtaggaagacatggtgcagaagagaaacagcaaaccataaaaacaaccctcagtactcttaatatagttatatattactcagagatgcatactcatagttaagccttatatttgacaaatatgtacagtttctcttaatttattttattctttctttttaacaaaattgcatgttcctacaaggcagaaaccatggtttatatgacttttctgtccttccttgggcctgttgtaggatcaaagacatgaaatataggaattggagagaaccaaatagccacccaagtgcttggagagaaccaagtaacgataccaagccccagtatggcatgtaaattttgtcttgaagacaaactcgtcaacagaagtggctttttggaatgtcatatagattgatgtaactgagtgtcatgggcatgataggaaggttatctctacaactagtttttgtaaaccttcatttttcatctgaaaagttggtaccccagagaggatgaggtaaatgccttatttgcaaactattcaatctctcccccgtgcttattaaatatgttccatatttgtcagcatgacagttaagacccagtgtagtcttcctagggctagggatatgggaagatccaataatatcttttttcaggtataattattttcagacgtaaggaattcatttcttttcttaattttctccagaggccattccaggtacttcatttctctggaagttacaggcataacccacacttgataccttgaatcatttctctctaacacacatgcagatgcatgggttaggtttgtgagaacataagcctgtagattaaaatggggactaagaaattaagaggaaacaaagcttaagccaaaaggctctctagaccagatcaagacagaatctagtctggaatgtctattcggtcaaactttaagtaaatgatcaaaagtaattctataggtaagctttaaaagttgagatcgtggacatgtcaagtagaaataggaactcagttatggaagaccatagaataagtatagaaattccatacccttggtactaggaaataaggatagattgtattgaaaaattagttaaggccaggcacagtggctcatgcctataatccccacactttgggaggacgaagcgggcagatcatgaggtcaagagatcgagaccatcctgaccaacatggtgaaaccccgtctctactaaaaatacaaaaattagctgggcctggtgtatgcccctgttgtcccagctactcgggaggcagagggaggagaatcgcttgaaccctggaggtggaggttgtagtgagccaagattgcaccactgcactccagcctgggccacagattgagactttgcctcaaacaaaaacaaaaaaaaaagaaagaaaaagaaaaattagttaaaccagattatacctaaatgtaagaataaataatgtcaatttaatggaaattgttgattcagtggatttctatataaaataacatttatttaaaaataaatatttgtggtgtttccagtatgtatcaggcattattttggaaatgaatacatatacatgaagaatacaatccctgacttcaagggataagtgaatgaaagggtcagattactttcagaacacaaagaaataatcataatccataattgtgaggaaacacagaatggggtagaaataattctgctggagaacctatggaagaatttataaaaaaaagtgacacttgaattaaatcttaaatgagtgggaattgtccaggatgcaaaatgatggtggaaaacatgcagtcaacaaatggaagagaatgcatgttcaaagctacagaggtataaaatattatgggaacataaagagcttacaggctgtgaattagcaggaagcctatggagaagagtatcttcttgtttcccctatgcacatgctggaaaagtagaactcaacaccaattttacagtgctatgattataaagacttaattttaaagacatgctgaatgcagtgtgaaagcaagcattactgtattcaggatttgactgaaatatcagtgaccaaactattgtatagaaagacaatcaagctgggcgcggtggctcacccctgtaatcccagcactttgggaggccgaggcaggcggatcacgaggtcaggaggtcgagaccatcctggctaacacggtgaaaccctatctctacaaaaaaaccaaaaaaaacaaaaaaattagccaggcatggtggcaggtgcctgtagtcctagctactcgggaggctgaggcaggagaatggcatgaacccgagaggccgagcttgcagtgagccaagatcgcgccactgcgctccagcctgggtgacagagcaagactccgtctcaaaaaaaaaaaaaaaaaaaacagacaatcaaatggtgatccccatttatgtgcttgctatctctgcaaagatgcaaagattcagggactctaaggctaagatgatttatgttttctgttcttagatactggctatgcttttctgtctattggatatgaaagaaagtggcaaagataaagctgggggtgtaaactggaaccaaattgcaaagactttaaaatgtcctgctgaagaatgcgcaaattattatccttatccgtgttgatgtttaggaaaagagactacagagagttggctctgtgacatacagagagaagggagccagaaagcacagggggctaacagaaatatgagaacttaatgaatcacattgataaagtaaatccctatgtataacaacacttattttgtgataacatttattaaaaactttggaagagtctagttacaaaccagggcagagaaagcatccctggcaaaggcactgagaatctgcacttaaacccaaaccaatataaagccaatatcctgcagtcccaggctgaagtgtttacccaaacaatgtcctaaaaggacaagaagagtggagctgtggctatagatatccaaattagagagaccgaaaccatcaggcagggccaagtcctgtgaagaaactttccccaaaatagggcagggaggtctgggaatagagaccagctccaggaaattgggctgaccagaataaataggaaaatagcccacagagaggtgaccaaaataataaggcagggccctcttcccgctattcccagggtcagaagtgagagtgggtggaaggagaaatgttttgtaaccaaaggatatgggcaaattggcttttcagagtacaatattttgacagactactgcctctattgctgagtgttcacaaattcatttctcagtcaggaattaactaatactgcgtttcagcctaggcaagagagtgagaccccatctctaaatttcttctttaaaggaattagctaagactgcgtctaagccaagttgaaacacttcaggaaattctctcaatagccaaccgctcttgattttctgggtgtcaaggggtagtggagtcactaggaatgttttgaacttcattgtcaggaggtgggatgatgcagaggtgaaataactatacaagcaaggtagttctctccctgaccaaggatgtagccaacagggctctttaaaacccaaccatacacataaaaaaaagtctcctattctggctgatattcactggcaatgtgtacatttaacagagacctcatcagaaatgttgattggagctgaaagccattgtcctcagatatgatttaaatgtaaaaaagagccaaaggttgaggagcctgaagatccgaaagcttctgggacttcattaagaatcttctagggatgaacaccttcactatgtttctataatacaaagttttcctcaaagcttcttcacttatcctttgcttcaagcatgccacccactctgacccagtttcttcccatttccatttctctccatttattcccttcagtcagacaacctggttggaccatctgcctggacatggatttagatttgctctgcatactacttctctgatgtaccattttagttgcatatcctatgacccatgggcaccccacttgcagtgccatgggcagctcgagctctcatgacaacacagccttggtctatcctcctttgcttccacatcttaggtggaagatcttacaggcaaggaaaaattcatgaaatgttccaaacagaaagcatcattaattggacctgctttagtaaatacatgaattaacattttttcttgccaatgacagaattctaactttaactggcttatgcaaaagagcaacctctttaagcactgtttctcatcaactgagattttcattggctcctacctcatagggatgttgtgaggatcaaatgagataaactatgcaaaacctgtagcacactgcctggcacatagctggaattatataaaattagctacttatatatccaactgtattctgatggatggccaatgattttggaatgtttgagaaaagtagcttttctctcacattagttttcatgcttcaagacctcttaattaaaagcatctgtgagaaccaaattgtagtttctgtccttgtttatagtgtcttgattttgtatcttatgagaaaaactgcttctgaacatgcttgaccacactaaggccagattgatgcccttccatgttctcagagcactcaaatgactgttaatcttcacagttatcattaggtgagacaattgcctatttatggctctttcacaggctacaagccttctaaaaatttgtttgaaccccacagagcttagcacagggcctggcatgtaacagacttacacaaaaatatgtgttgggtgaattaatgaatgactagaagagcaattttttagcattctggatatgatacagagctgtagggttgtttttgtcttttacctactggaggtattgtttttgttgttcctggagatgcgtttcacttagttctagtacattattctttaaatattttactgattttcattcggaaatatttcatttaaggctttaaaaatcattaatgattagagaaatgtacatgccctttttctttcaacttaataaataaaattaggaatttatgtatatacttcatatacataaattcaaaacttggatttcagggctcttaattaaaatctttaattccatacttctgttaatttttagcatacaagaaagccatatttctaaatatattaacatacatacttgttgtatactatattatccacatattatttttaaacaataatatcactaggcatggtggctccttcctgtaatcccagcactttgggaggctgaggtggaaggatcacttgagcccagaagttcaaggctgcagtgagctatcagcacgccactatactccagtatgtacaacagagtaagaccctatctcaaaagaaacaaagaaacaaacaaaataaaaataaaaatatcaatattaccatgacaagcacaaaatgaagattaaagtatctttatggttctttctgttcttataatatatccctgcaagtttgtatagtcaaaacactgaagtcacttgacataattattctatgtggtatgccatcagtctaatatacatttaagtttgtttcagtttgttttcaatttgaggaattgcgttttatttatgaagtattattatttaattgtgcaaataattttcattatttctaagtcaaaccctataccaaagtacattcactggagtctcctttccatccttaatcatcgcacactattctctcctccctctaacaggcagccatttaaaaatttttagttttcattatttgaactaagtgtatatatacacctattaatttttatgtctgtatgtatacgtgtgtgtgactgtgtggataagtgtgttatatctactaatagtaccactttttgagatttctgagatgctttaagatattcaagatacaatgcagaataggcagttttgttttgttttttttaaaaaaacagattgtttgaacttggaggttgttctgggttcttgtagaatcaaatataccacaaagtcagtatattttaaagcattatcagcgaaaagagtttaaaactaggacattttgtgtgatatgtgggttttaacaaatggaagacactctggttttcccaagaccactaaggtgcatttttagcttacagatgacgaaacttacccttaactgcaattttggttcaatggtttattcctaagtccttgagtctcttctttctttgactttgtcactgtttctcctgtttttccaacatatcgatgcttctccaggggcagggagctgtggtgaaatatgtcaggtctgcctaagctccataacttctcccatcactgttgttaggaacctctagattctctaattcttcaattctcttctcctgacaaatctgaatacttgtttttatctggagatttaagcccatctcagtctaggacacagtctgaaggggaattatgttagagactcctgcattaaaatgcagttggctcagaatccagcctttttcatgctgttgggctctgtgctagtttctcatactacttgtctaatctctggacattgtcatttagattcctgacctcctgattgtagactgctcatttttgtctcctcctgtgcatagtcaacctgatgaccatcttgtactctgtccttgccatgagcgtattatttctccaatgtagtgccatatttttgcctagttcaattccttccttctactgatggcccaacgctgataactgggcaattgcaagcatcaccactcttaagcagggcttaatgagacaatcctgagatggtttcagcacagatccaaggctttcttatgcatactacagagtctagaacaatcccaaattcttctccattgctcctcaagttggtgctgtggtaagaacataggttctggaatcagattactaggttgggatttagtttctatcacttattagtgatgagaacttggacaagttacttgatgactgtgtgcctcagtttcctgatcagtagaatgagaatgataaccgcttacttcataaggtgactgtgagaattaaacaagttgtacatttaaaagacttagagcagtgtttggcacatagacaagcaataaataaatggtagatatcaattgttataaacattttattattgtcaagggatcatcaagaattacaagaggtaaaatattgtggagtgcttataaatatatgattacgagccatagaaagccctaaagcataggtctcaatttcatatagcagttagtcaatctgtgggccagctccactattacttggaatacttccttggaagagattgactataatacttcttaatttgaactttttaactttttttttgaaagatgcataataaacaccaatattattcaaataaacttaggaatcatatgttgtccaatcacattatagcatactattcaaagaaaacacacatttccaaaagtttaaagaacaacgcagtctgtcattatccagtttggagctaacatttttaattgttttaaggtagattgtcaatggcaaataagaaagtttgaggtttctaacctctatttggttgtgacctcatagggtttgctaaaattctactcaatactgttcttccttgtatttaaccccaaataaaatcatttatcaactgttaaacataagacttggataagttttaataacattgtctaaaataaaaataaattttatgcctttatcagcatgtcagttgtgcacatctgtgatagccaagaagcttaaagagaaaatcgttgccaatagatctttcacaatgttttgtataatatacaggaaagaactttggctacctacattgtatttaagtggcaattacaaccaaaattggtgttatattttgtaattccctccccataacctactctacagccactggctgcctggccaacaatctcagaatgtgccatcctgttttgaatggctcttttctgcacttaaaattctctcctcccttttttctggctctaagagaaggcacaaatgacattttttgacttccctgaaagaagtagttgtttcttgtttttaattcattcagttcagtaatttaacattcagcaattacttaccatattcccaatctaggaaaaagtcattgtttctctttcctcatgttctcactttagctttgatataaggtcctcctatgatctgccctcttgcaggcttctccttacagaaagaggattgatttaacatactggtgtgatgggcagagcttctcacccttttaaccacattaacctctgaaagaacgtcttgcatcaaaggcaaggaggttgtagttatatctctgaccctcatctgcaatcaaggaaacttgaagcaggctgacattccccacatgactggctaggtatctttctgtagacataactctcctataaaggggtcccaaagtcaagcaagtttagatgggggaatgggtaggaaacacattttggtttggggcccaagctgtgcttgtcaatccatctttattattaatattatccccaatctgactcttccatttttcagttggctaacaatctgtagagccagaagaatgtgattatttagggttccctcaaaaccctcagtctcagaaacatgaactctactacagtgaacaatatacatagttcttatactcaagaaacttaatattcgatggtgttttcacaacattttgcacctatctccacaacagaattcaacaatgagattataattttttgtttaacttctacttcttcatctataccataagcagtgtcaggcaggaatgaaatctttctcaaccatactaacctcagaacctagcaaactggtaggtgctaataggtggttataaattgggtgcagataaaacaattgccatggaatgtttcacctgaccaacttcaaaataagggcctgattttaaagattaacccacagaacttatttttgaaactgtaagttgatttctagcacaggactttcagttctcatgttctcaggtttagcaaaacttctataaaatagtactgtgctctctcacttgtcatttttactttgtggcctttcctgtttctgcctaaaatagaactttctaaattagtctatcctataaatgtgacttggagtcctaccacacctgactttgggtggggaaagatgggttcataaaggttaagtggaacacaagattcacaaacatcaaagtgcatactgattatctgaagatcttgctaaaatgtcgatacttatttagcatgtgaaggctgagattctacatactaacaagctcccaaaggattcccatgttactgatttgagggccatcttttgagtatcaagagagtagatgactcactttgcaaacacagtcattcattaattaaacattatttaatcataatatgcgccaaacactgagctaaaaaactgaggaagaatgtgacatagtccttgctcataagaagcccacagtctaatattataggaaacataataagaaataagtgctatgaattatactgagaggaagagaagccacatactgaaataaattgtttgccagtgggagctaaacaaatggcacacatggatgtaaagatggagaaaatagaccctggagactgtggagatagtggggaggagctgagggttgaaaaattcctactggatacaatgcccagtgttttggtgatgggtatactacaagcccaacactcaccattatacatgtaatacccatgtaacaaacatgcacatataccccttgaatctaaaatttaaaaaagaaaaaaaaaaagactacatgcaatctagaaaaagagacatatttgataaaggttgttatcaaaactatacagagaactcttaaaattcaacaagaaaatgaacaacccagttaaacaatgggcaaaagatctgaacagacacctcactaaagaggatacatggattacaaataactatatgaaaagatgcacaacagtgtatgtcattagggaattccaaattaaaataatgagataccactacacacctattcgaatggcaaaattccaaaacactgacaacactaaatgctggttaggatgtgaaataacagtaagtctcatttattgccggtgaaaatacaaaatggtacagttactttggaagatattttgacaatttcttacaaaactcaacatactcttaccatacaatccagccatcatcctccttggtatttacccaaaggagttgaaaattgaaatgtgagtcataaccataacaatgctgtctcacacctgtcagaatggctactattaaaaagtcaaaaaataagacactggtgaggttgcgaagaaaagggaacacttatacactgttggtgagagtgtaaattagtttaaccattgtggaaagcagtgtggcaattcctcaaagagctgaaaacagaactaccatttgacccagcaatcccattactgggtatatatccaaaggaatataaattgttctgttttaaagacaaatacatgcttatgttcactgtagcactactcacaatagcaaagcatggaatcaaccaaatgtccattaatggaagactggataaagaaaatgtggtacatatacaccatgaaacactatgcagccatgaaaaagaatgagatcatgtccttttcaggaacatcgatggaactagaagccattacccttagcaaactaaagactattgcatgttctcacttataagtgggagctaaatggccgggcgcagtggctcaagcctgtaatcccagcactttgggaggccaaggtgggcggatcacaaggtcaggagatcgagaccatcctggctaacagggtgaaaccccgtctctactaaaaaatacaaaaaaaaattagaaaattagccaagcgtggtggcgggtgcctgtagtcccagctactcgggaggctgaggcaggagaatggcgtgaacccgggaggcagagcttgcagtgagccgagatcacgccactgcactccagcctgggggacagagcgagactccgtctcaaaaaaaaaaataaaaaattaaaaaaaaaataagtgggagctaaatgatgagaacacatggaaatatagaggggaacaacagacattaaggcccactagagggtggagagtgggaggagggagaagatcagataaaataactaatgggtactaataggcttaatacttgggtgataaaataatctatacaacaaactttccatgacactggtttacctgtataacaaatctgcccatgtacccctgaatttcaaattgaagtttttctaaaaccctgcacacaaatgtttagagcagttttattcataattgtcaaaacttggaagcaacaaaaatgtccttcagtagatgaacagataaactgtggt

SEQ ID NO: 281 - DNA, 14161 bp, Homo sapiens
  4th Enhancer of BTLA
agtcattagttgaagaccgattccaaggatagcactagcacttcatcctgctactcgggtaagtcaagcaggctctggtagtcagggaaagctcacaggaaaagaaatgcaggtgccagcaacaggaaattaggaagtgtgcagcaaagtgagaaggtgagggatagagatggggatcagccaccatctgctgcaaaaggcacaaacactttttttctttttttttttagcttttgttttgttttaagagaggaaggaagggagacaggacaaaaatcacagggcctatgcaaagttaatgtttatatacaagaaaaggttatataagtgtggaagggagatgcagagttcaacaagcaagccactgtattttttaactctatagtaaaagagaaacacaactctgaagaatcaaaaaactttcccccttggaaagcgatgtattaaaagaaacagaaaatattttagaaaatgttcatgttcttaatgtgattcaatagttcactgttccttttgagaagatgatggtggcagcagcatagtttttaaatctttccaaatactcacatccaaataaatagggtaactatataacaaaaccaaaaactcatgaataatttttacaaaaaaaaaaacaggtaatgaagtatatcacagagcacaatatacaagtagatgaagacaaattaccaacaggcataaatctgcatacaacaacttctgtgcaagaggaagtagagggatgcaatgggacatctgacagagatgagaacaagagaaccctcaaaatagctaagaggaactcactgcagcacacagtgggccaaatgggttcagcagctgaacctgggaggggtattccagcctccataaattttcaaaactaagccaccatggcttcctcccagggagccaacactgtatagaaattgctgggagtggcatcaaaatagaaaagaaagaatagtaataataaagatgaagaaaagaaaaggttactaaaaggtagaaagaaaaacagttcaaaaagcaagctactatatttttttaactctctaaagagaaaaagcaaaacagaaaatagagccctctcaaagtagaaaaactaccctgtgtcattcctccttctaaaagtttggaaaaaaaaaactaagaaacaggaaagtggtgaggtcaaatcccatacgaagttattaaaagaaaagagaataaagaacagaataattttcctacaaacaatgaaagcatgccaaaaagacatgtccacagaatagattcttaaattaagtaacacaagatatgaaagaacaacataagttggaatccaaaaaactcaaaacgaggcaacaattcagaaaagaattagaaataaagaaactcattttagaaacaaaggctaaacaataaggaacacaagaatgactcaactcaacagataatgcctttataaaaagagaaggtgaaaataagacttttaaaaatgcacaataaattaatagataaaaaggattgaaagtaacgaatattgaaagtaggccaagaagatttaatatatggttaacagaaactccttatgaagaaaatcaaagcaggagaatactaacaagtataattttttaaaaagcctcgaataaaaaaataatgttctcctaagaccactatgtgtgtaatgtggaacaaagtaattgtggaatcatctacttctaccaattgctatgtctttgagaattataattctccagttctccatgtaaagaaaggaaatacagataaaatataaagttaggtcaaagactctggagagttggatagaattggagaccattaggctaagtgaagtaactcaggaatggaaaaccaaacatcatatgttctcactcataattgggagataagctgtgaggatgcaacaacaaaggaatgatacaatggtctttggggactctgggaaaagggtgggtggggcatgaggaataaaaggctatacattgggtacagtgtacactgcttcggtgatgcgtgcacccaaatctcacagatcaccactaaagaacttattcatgtaaccaagcaccacctcgtccccaaaaacgtattgaaattaaaaaaatagccatttaacactgactagtttcctaatatctatatccagctgaaccaccctgggtaatgaaaaatgtctatgtgttccttctatatctgccctgattcttctgacttcagggaaagaaaagaggtagtacaaaaaccaagtagtagtagtagaaccaccttctaaagaggacccaaacaagacaacaattgtccaaggatgacaaaaggttttagggcagccatagtcaaagacacaattgacaaggaaatttgttacctctgtggcatacgacaatttagcataacaattataactgttactgataatgtataccaagtcatatcagaattataggagtttcccatgatcttggaacacatatcaataacacagttatacaactacagcccaaacgaaaccaatcaccatttcatatttgacaacgcttcctgtgtaatttttatactaaatatgccaaattatgtcatttttggattctagggaacctaatatcttaaaggattaattaggtcagaaaaatacataattttaaatttgattttggaaagtctgtcaaatattaaaggtttaaaacacttgatatcacaggtcattgtaaaataagtcattcatttgaccaaagtgataactcaaggatttcaaaaaaaaaaaggtaagaacctttattctttgggagaggagacttaattttcaaaacaataaaccctaatgaaacagcatgaagcctattaaacttgtttttcaaaattttatcaacagtctataaaagtttaatcttgaccataagatataacttccataagccttttataagctttataacatttattaaggagtcagttaatgcttcaagaaaaccttgttaatctgactcaagagcccatatgctggtcttgcatcagtgtgcctttgacattaatgattaacttatagagaaactgaacttattttatctctcaaaattggccattacaatcttacatccctacctcttctgtgatagtcccagggcctcaaggagttgaatagctttaatttctggccctgtgtttcaggaatacagtttattttgattggcatcttctactgggtgtgaaaatgaggctttcattttggtcagtgtttaagatttagcaggacttggtgtcctttttagacccaggagtcaaagccctgtaactcaatgtcacaaggactttaaaagcacatacagaaagatacatgaatgtaataaccttaattaaaattttttgtttcattcttcatcctaagcacaccaaaacttaataataatggcataggaatagtttttataaaccataaaatctggtagtccagttaccaaaaggcaaaagaaaagaccttctgccctccacagaacattatgttggaagaaaacatttcctttagatctttcagaaaacattgttagcatcaggccacaacaaacagaactcaaggtaacaaatttatatgaactgaaaatgagttgaaggggagtattactattttgcatcctttaaaagggaagagaaaactgaaaatggtgagatgcaataaaagttgaactttgagtttaaaaaattaaaatatattataatttgttaagagtaaaacaatcccttggctgggtgtggtggctcacacctgtaattccagcactttgggaggccgaggcgggcggatcatgaggtcaggagatcgagaccatcctggctgacatggtgaaaccccgtctctactaaaaatacaaaaaattagcaggtgtggtggcaggcgcctgtagtcccagctactcgggaggctgaggcaggagaattgcttgaaactgggaggtggaggttgcagtgagtggagatcgcgccactgcactccagcctgggtgacagagtgagactccttaaaaaaaaaaaaagaaagagtaaaacaatcccttaagaaaatttcattgttctaaccaaatatttagtgtgtaagtgtttttttcttacatcaagcctaatctctagaaagaccattacaatttccctttaattatagacaactttaacatataaaagttttttgtaatatataaattctcttattgtgacttacacagactgttcatgacatgtttggactttctggtttgtgctgaacatcccttttctttaaacaacctgtcattttattctaggactaaacttaccataaatgattctttctcatataaaattatgtctctttaagctttcttacaggaaaaaaaaaacctctttatttttaaaactttcttcatatctatttcctggttccttttgccttgttttatacataacctttaaataagctttgaattagacaaaaatttttcaccttttaaaaaatgacacacttttgattttacaaagaatgctttcctacaatatattattggaaaatacccaaataatggaatatctattatttaatataactttagattctaaattataatgagtttgtctacaagtatttatcccattacatttgcccaattattttattttaatcatttacctagattgtttatggaaattgcaatagtcattatttaaagttatggaactgccattgcaaaattataactggggcagtaaaaaagatctgacctaactgactccaccttgcttctaacctccaacctgtccttgtttattcctgtgcataggccaaactaactttgggaggaacttagtttatagtttagctttgaaacaaagatggtaacagtccttttccaaaacataccttactgcctgtggactagacctcctaaagccacaagacaagaagttatggtaatcatactaaattcaagatgtagctattttcattaaaccaatatcaatgtcttatttattaaaaattacataagcaaagataattctgtattaggttgggtttatagttttgtaacccctgtgccaaattttgacaccttatagaatttggcagggataagtaggaaattgcttgaataataaacacaaacaaaaatgtatgctggcaatttgtaagacatttctaatattaatttagcaataattttaaagctagcttatttattaaagattttacttaagttatgtaaacttgaaaaagcatttgactagtcctttttcctgataacatatttgattcaagcacttttattttcataagccaattaattagagttcatattttcagtagtgaaacatcatgtacacaatgcataaatacatagatgtattaggtatgctgacagaagtacactttacagattcttaaagatcttttttccctatcttaagactttcaaatttttttttgtttctttgagacggagtttcactgtgttgtccaggctggagtgtagtggcgtgatctcagctcactgcaacctctgcttcccaagttcaaacaattcttgtacctcagcctcctgagtagctgggattacaagcatgtgccaccacacctggctaatttttttgtatttttagtagagatgaggtttcaccatgttggccaggctggtcttgaactcctgacctcaagtgatccacttgcctcagactcccaaagtgctgggattacgggagtaagccactgtgcccagcctcaatttcttgataacctgttttactaccctaggcagttgtcagctaactagccttaaatttgcatattaaaggaaacaggtgaaaatcaaacagcaaaatttacattataaggtactgaaagaaaaagtctcctgtgctagaaggaagttaaaatggatttaattgccaattcaacataaaattacataaattataaaggccttttaaatatgcacacacacaaacacacacacacacaaaatcttatagcttttacttcagaacttaagccatgaggcaaacacaaattcacctgcttgcaaacaaacagcttgctgagtccaaacagtgctttgtatcttaatagaaaaataacagcagatttaaagctggcagaaaggaaaatagggaaaaaagagaacttaggaactctatagtttgcaggttgaccttagtgctctttttcattaacatatatatgcacaaataccatattacttccatttcacataaactctggcaagtggaggtgccataaaacctatggagtgcttgaaaggggatcattctccttgttttctcctcattcttagattattattttctcattttttttcttaaaataactgagctgtggcctagcgtttttgtgtggtgatgtgtgctgcttgcactcaagactccacagtgtgttaccattgagtcattttcaccctcttaagtgtttcagtttctctctccagaggtctatgacctgtgagaggactcaaaacgccaggtgaccagcccttatatgcatttcctggatgagcctttttaaaaaataatttttgttgggtgtttccctgtagggctgctgcacaggggttcaacccccctaaccccttgcccagatacacccacaaggcctctggtcactcagctgagtcaagtatgtactacagttaattttgtgtagtttaatactgcctttacatttgtttatatttttctgaacttcaaattgcaccatgtatggtgtgtgtttgcttgtgtcagttttgataaataactttttatattttgttatatgttatatgctcatgacataactttttcttaatttttttgttatctctaggctaagtggttcatctgagttttttcaaatcgtcacaaatctccaaaaaaaattccaatatatgtattgaaaaaaatccacatataagtcaacctgcacatttcaaacatttcaaacctgtgttttcaatggtcaactgcaatttgggtaaagtgtatggattcctgtaaattcctttaaaatgcattttaaaagatgaattaaatggatgggtaaaggtacagatagaaggatagttatattgttactatagtaaaatgttaatggtagaatcaagatggtgtgcattagtgtttgctgtaaaatgaattcaaactttgttgtatgttgtaaataaaatgttgggagaaaagatgctttcacttgtaagtgcaaataaaaactaattttatttttaaaaatgctaaataatacattctaatattattagtgacagtgtagatatataagaactcatgtttttttaatttttgtggtgagtgtataaattagtataaactatttagaagatagcttaaaattattgtatatattaaaatagtaaagtggctgccaactttgtattcttacttccaagaatttactccatgggaattatcacacaagtgtgcaaagatgtaatcaagacataagtcttgattataacagaaaaaatataagcaaattaaatgacctgttagatgattaattgaacatccatacaactaaatactaggtaagcattgttaatcataatatagatctattaatatatttcttaaagaagacggtcccctcatattgtttagtgacgaggattacaggaatacataaatggtacaatcccagttttggttaatgcatacatatccatatactcatttacatatattcatgaacatatacatctatatatgtatttagacacaaagggctcattaaaagaatattcatcaaaatgtcaaaaatattagctccaagagataataatgaacctgattttttattttcttctttgtacttgtttgcaatttttacaatgaactcataatcctttacaaaagcactaattattatttgaggttgtgtaggggggagtaagacagaaggagaaggaaatatagtccaataatgaaataaaatgaagcagcctttatgtgtttgtatggattgatctccaagattttttatgtgatcattatagactgaagtgtgttacaccaaatttcatgctgaacttctaatacccaatacctaataatgtgactatgtttataaatagggtctttaaagaggtaactaagttaaaatgaagtcagtaatgtaggcccttatcgaatatgatttatgtccttgtaagaagaggaattttgtacagatattgacacagattctaacttgaccaaacttcagtcaggctccctaaccttctcctaggcccatctgtgcacctccttgtaaaatctgctttatccaaaaactcatttagtaagaacccctctcccccagtagctgatcaaccgtgacatctgatcaagttcctcatcctccactatcccacaggtaataaatcaccttgttctgtttttagcaagaatcctgtgaagttggtttagctgaaatcttcctcacccctgatgtttccttttagtaattttccatccattgacccccaccctgctccttggctataaattcccacttgcccatgctgtgtttggaattaagtccaatctttctcccaggctgcaaaatctcattgtggtgttacctatacctattgcaatggtcctgaataaagtcttcttcactgtgctttaataagtattattattattattatttttgcatttctcattttctttgtaacatattaagtgtgtttgctttatgttctctgttttacaatttcaagatctgaactttagttttttattttattttacattccagggtacataacctgcaggatgtgcaggtttgttacataagtaaacacaggtaaacatgtgccatggtggtttgctgcacctattaacccatcacctaggtattaagctcagtatacactaactacttttcttgatgctctccctcccccaacccccaccgacaggccccagggtgtgttgttcccctccctgtgtccatgtgttctcactgttcacctcccacttataagtgagaacatgtggcctttggttttctgttcctgtgttagtttgctgaggataatggcttccagatccaaccatgttcctgcaaaggacatgatcttgttcctttttatggctgcatagtatcccatgatgtatatgtaccacattttcaatctatccatctgacaaaggtctaatatccagagtatacaaagaacttaaacaaatttacaagaaaaaaaaaaccccattaaaaagtgggcaaaggacatgaacagatacttctcaaaagaagtacagccaacaaacatatgaaaaaaagctcaacatccctgatcattagagaaatgcaaatcaaaaccgcaatgagataccatctcacaccagtcagaatggtgattactaaaaagtcaaaaaacaacagatgctggtgaggctgtggagaaataagaacagttttacactgttggtaggaatgtaaattagaacaaccattatggaagacagtgtggtgatttctcaaggacatagaaccagaaataccatttgacccagcaattccattactgggtatatacccaaaggaatataaatcattcaattataaagatacatgcacatatatgttcattgcagcactattcacaaacagcaaagacatggaatcaacccaaatgcccatcaacaagcattataaaataatttttttctttaacaatatgcatacaggaagaacaccatgtgaacatgaagacaaccacctacaagccaaagagagaggcctcagaggaaacaaccatgctaacatcttcttatactctagccccaagaaatgtgagaaaataaatttctgttgtttaagccattctgttcaatctgtggtagtttgttattgcagccttagcagattaatacagtgataaaagcaaaaactgtatcaatatatatagcagtggctttcaaattttcaatatatatatagcagtggctttcaaaatttcaaatttttcacaatctacaatatgaaattaattttaccactctacccagtatgcatagacagacatagctggaacaaagaacaaaattttttcttgctaatgtatgttgatatttttacttgtttgattgtattccatcatttcatattaagaaagacacaataactgattttgcaactgatgaactggccaaatgttaaaaaatgctagataagaaatactattatttgttaaaacaacaacaaaggccccagcaaactagattctttggatagaggcagaaggggcatttgtgagcatctattttttaactttttttttttccaaaataaaatcttatgagaaaatccaatgtatcaaacagataaatgctgagttactttggtagacagtggtggggagagaagtggagccttcctacttatccctgacagccctgatgcagctcaacagcaccaatggctcttgggtacaggacttaaaaaccaaatatttattccactcctctcattatttagaaagggggacattggggtaagggacaaagctgttaggagggccaggtgcagtggcccatacctgtaatcccaacactttgggaggctgaggtgagaggatcacttgagcccaggagttctagatcagcctgggcaacatagaagaccctgtctctataaaaattttttttaaatttaaaaaatttgaaagatgttaggtgatatggtttgtgtccccacccaaatctcatcttgaatagtagctcccataattcccacatgtgtgggagggaccaggtaggaggtaattgaatcgtggggacagtttgccccatactgttcttgtgatagtgactaagtctcacaagttctgatgatttttatagggagtttccccttttgcttggctctcatttcttccttgcttgctgccatgtaagacataccttttctccttctgtgatgattgtgaggcctccccacccatgtggaactgtgagtccattaaacctctttttctttataaattacccagtctcgggtatgtctttatcagcagcgtgaaaacagactaatacattaggagattgagattgcaagttctaagcgaggattgtatagatatagatgtaccatcattcttcaataattggggaagtgagaatctcaaatataaaagaggtccatcaataacatccatctcttctttccattaaaataagaaatataaaagtagaaataatgcttggtaaatgtgacacatctccagtaggctcatatactaacttaaatcttgtgctgttccattgccctctgctggatgttcttagtatctgtggcctcaaaactagaagttctagtagtggtagtagtcacagcaatagtgattattatcattattgtcattttagcagcagccatgttgaggtcaagcactgtgccacatgctttacatccaaatcctcctaacaactctatggctagataatgctctctcattttgtagatgtggaacctgggggttcagaggtaaataaacaaaccaaggttacacaactaaaagtaagagacccgggaattaaatattggttctaaagcctaggccttaattacttgctgttcattaaactttcaatctgtcagctgtgttggtgataaaactggaatgatattactagttgggatcttttgattcactgattattaacaatggaatcacaacgatctttattctaaaaagccaaaaattattatcttcctaaaattaccaaaaaggaaaagcttactcctcaacagagcaggagagcatgttttcagagtttctcaaagtgtgattcaggaaactcctgcattggaatcacatgaggtgctacttcagggcagaaaatcctatgcaccaggatgtattttggaggtagagaggacagagcttgttcctgagagctgggatatgtgttagtggagtgagtgtagagagaaagaggaacaaaagatggctcctaaaatttttggctcaggacaaattttgaggagagtagtggcattaactgagatgagaaagattattagaggagcaagggttttaattgttagttcagttgtggcagttacttttttggcagcagatataaaaccaggagtttgggtttagatattatatttatgttgccatataggtaaccaaataaaaatggtagagctaactacaaataacttttaaaaattcagatctatatttaagatctattcatgttgtttcacgtgtatctctttctaattgctgcataatcctttgtaagtctatcagtagtaagagaccagattacttccaactcccgccaccacaaccaacacagcagtgagcatcctcctatacaatcctttaaggtcctctgcatgtattcttttgtggtataaactcaggagtgaggtatactcaattggattcgatactgccaggttactccctaaaatggctgtgctggtctataccctatcagcagtgcacaagagttcctctaccttcacatttctttgaatgctaataactatccagcctaatttttcactagataaagaggcatcttattgttttaatacatatctctctgataagtttgagtatctttacacactcgttggacttttgggtttctgtaaattgcctattaatatttcattgtttttctttctttgccatgtgataactacatatttatgggatatatagtagtatttcaatatatgtatacaatgtgtaatgatcaagtcagggtaattaagcatattcattatctcaaacatttatgatgtgaacattcaaaataaaaatcctctcttctagctttttaaaaaatacacaatatttcccttacagtgctacagaacactagaacttattcctcctctttagctataatttcgtatctgttaacgaacttctccgtatcctctcctccccactactcttccttccccactactcttccttccccactacccttcccagactctaaaaaccacaattatactctctatgagctcttttttgtttttttggctcctacatatgagtgagaacatgtggtgtttatccttctgagccatcttatttcagttaacatgccctccaggttcatccatgttgccacaaattagaagatttcattcttttttatggccaagtagaattccattttgtgtatatacaccaccttatccattcatcttttgatggacatttcatatcttgactatttttaacagtgctacaataaacatgaaggtgcaggaatctctctgatacatagattttctttcctccggataaatacccagtagtgagattgctggactttcttagcactcatgttaaaaatcatttgaacatataggtgagaagttattcctgggctcaaaaacaaacaaacaacaacagacaacagataaggatacagcatgggccgggcacggttgctcacgcctgtaatcccagcactttgtgaggctgaggtgcgtggatcacctgaggtcaagggttcaagaccagcctgaccgacagggagaaacccccgtctctactaaaaatacaacattaactgggcgtgctagcgcatgcctgtaatcccagctactcaggaggtggaggcaggagaatcgcttgaacccaggacgcagaggttgcagtgagccaagatcgcaccattacactccagcctgggcaacaagagtgaaactctgtctcaaaaaaacaaaaacaaaaaaccagcatgatttcaggagcagaaagagaataacttaaaaaccagcataatgagaaagttaggaagcttcttaccaaagcatctggaagtatgcaagaaattcttgtgaactaaaattttcgtgctgtactagcaaacactacaactcacttattccatctttctgtattttgggacccaattatccacttctcttcattccctatcccaccccttttcttcctagcgtctgctaaccacctttatactctccaccttcctgagattccttttgtgtgtatgtgtgtgatggagtctctttctgttgcccaggttggagtatacaggcacaatccgggctcactgcaacctctgcctccagagttcaagggattcttgggcctcagcctcccgagtagctgagactacaggcacgcgt

SEQ ID NO: 282 - DNA, 3213 bp, Homo sapiens
  cDNA BTLA-001
gtctttctgttcactttttttcacaaaatcatccaggctcttcctactctcctctcttaccacctctctcttcttttttttttttttttagttatttcacagatgccactggggtaggtaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaagtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaacttatttgggagctttttatattatagccttgaataacaaaatctctccaaaactggttgacatcatgagtagcagaatagtagaacgtttaaacttagctacattttacccaatatacaaactcgatcttgcctttgaagctattggaaagacttgtagggaaaagaggtttgtgttacctgcatcagttcactacacactcttgaaaacaaaatgtcccaatttgactaaccaaccataaatacagtaatgattgtatatttcaagtcagtcttccaaaataagaaatttttgctgtgtcagtctaagaatggtgtttcttaaatgcaaaggagaaatcattttaggcttgatgtaagaaaatgaaaataataaatggtgcaataaaaatatagaatataccaattggatatagggtagatgttccacatacctggcaaacaaatgcttatatctactctgttagattgataagcaaatataggtattaatggagcagtcaacgtatagcacatttatgaggaaagtagagactcactgggtcacatagactaatggataggaatgtgacataatgctgctgaattaatatacttatgggcatctgaatagtttaaaagttagtcagaataggtatcactgggcaagtgaagatagcttaaactgcttcatgcttgacttgatagcaagttaaagtgcaattaatggaatggaggaaaacccagaatatttaattggtctgtaggggtcaatttgctttcattcaccacatctgcatcttgctgttcttcttactaaggaatcagggcaaatcatctgtagtgacatattttagtttgctaatcatttattttaaaatactgaggttgcagccacttaagagtatagcaaaagatggattcagatttttggactttccaaagtacttgagttaaactatttcaaaaatagcctataattttattcaacagtttgaggctattcgaattctcaggtgctgctactgaataatgtaatagtcttcatacaaagtggatagcaaaggttaaaatccatttcaacaaatatgtgagctgagctgctgcacaaaggaatgtgatgtgtgtgtgtgtgtgtgtgtgtgtgtgtgttaggtggggtgggtgacaacagaaatggtgcacgagaaactgatcaaattgacattatattttcagtttgcttatgaagctcaaaatactagagtaaatgggtcattaaagaaaataatatgtgaaattatggagtttagaatacaagtggggtatatatacaaaaagacaaaactgaggttttgtggtggagagattttcttaagtaacactggcattaagttttagctccttagatttgggggtgcaaatattcttttgagtcactgttattttgccaattacacctagaatttcaagcaaccaattcgagataggctgttttagccaggctgcatttgtggacaacttatgtaagaaagacatgttagaatagctgcttgtggtattcttaaaaatagaaacaggaaatatggggaggatacatttagctgtcctcttatcagatgaacacacgaaattgaacagttccttcatgattctctcaaacttaaaagcaaaatatttctgtcttatttaaaatatccttagtatgtcttatagtaaagataatgctgataatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattagtttatagagggtttgagaaaaagaatatgtagataatttaatggtttttcacaaattttaagcttgtgattgtgctcaatgagaaggtaaagttattaaaacttatttgaaatc

SEQ ID NO: 283 - DNA, 726 bp, Homo sapiens
  cDNA BTLA-002
atgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaa

SEQ ID NO: 284 - DNA, 556 bp, Homo sapiens
  cDNA BTLA-004
tatgccatggggctatgtggactgaaaagtgatgaaccagagagagagctggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaagtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaactta

SEQ ID NO: 285 - DNA, 531 bp, Homo sapiens
  cDNA BTLA-003
agtgtagctatagaaactgagctagatagagcaacacttattctgtgtgacacaggaataacctttgactgggcaaaagtgcttctggtattttggagtgagaacttctggagttcagaaccttctctggattctgaagaattctctcttaccccaattcttcatctgcaactccatggctctttctatggcctctctgtatctttcatcatctttcttgagactgctggaacctctctcagaacttcagaaaaggagtcagggataaatcttttgatttaccacatccaaagtgaactaggtagtaggagatcttggctacataggtgacaggacagcagcatttctggcattgagtatggaatgtccccagagcaaggacttccagtctcttccaagtgatatactagatccctccccttccttttagatatgccatggggctatgtggactgaaaagtgatgaaccagagagagagctggaaagcaaaatgaactctctgacacagcaggaagggaaattaacctggt

SEQ ID NO: 286 - DNA, 9428 bp, Homo sapiens
  1st Promoter of HAVCR2
atgtagagagcttaatatccatttatctatcattcttaaagcaaatgctaaatccccttttcaaagacgaaaactttgctattattgaggttatcatcaaagttttactgcaactctaaaacataggaatgtcccatacaacagcagctaacactttgctttttaaagtgattcttcttagtgcagggacactcatttgtctatgcttgttatacagcgaaattactgcctatgacatctcataattgaaaaatttggagtcaagattaaagctgtttacatttttagtgaaacttctcttaagactgtccaaaagaaaatgaactaatatatgatgctattatcaaaaggaaaaaaagaaaaagaaacatctttcatggtctttcattcatctcatcaattaggacacacaaggcagcatctttctctataatctgatctctcctatgacctgaattttctctttgatgttcattctgtccagtacaattgttgctatcatcagcatccattggttcagtttttactctcattcctgcttctgaatgaggcaaatcatcaggcaaagaagccaagcaattctgaatcatttcaattactcgttccaggtgcttttgaaatctctcagctgtttcaagccgttgacgtttctggacctccatcatgactctcaaggtctctcttgcttggtggggtcggtattcatttataagatgatgcacgtgtacaaaaagcagcttaagatcttctagtttctcttctcgttttatactcccagggctccttattaaaatatctaaaaggtccaagaaattaataaggatagacatattaagttttctcagttctttcttgtgatcaaactgcataggatgaagccgttcgatgccctgactttccaaagggcggatgataagatcatcacattggaactgattgccaaacatcatgtaactgtcttttattggagggggaggcttgggagctaagccttcttgaatattttcatccgtatattccttgatatattgcattggaggtggtggaagtgcactcacttgctgtggttcacccattgtggactatcaagaacctatggacacagaccaaagatttattagagccacaagacaaacctgttacatttcataactacagatggaatattttcttccttttcttccagcagtttggggccgaagacaagatgatctccttggtttctaaaactaacatttatgatagggaaagtctgccatcttttctaagtaggcattatattctcaaccattcacatattttccattctctctctaataatttcatcagcattaaaaaatatgtagcatcctctcatctctaaagaaaatcttctggactccatgcccctcaccacttatgccccatttctttactcttccataaccaaactacacaggctgtctcccaatctcatatcacaatcacttttgttttatgttatagatttatttccaatagcaaacacttacttgtatctctcataaacactctgacaaaattaacattgctaaatcctaaacacattattatccaaagttcctgaatgaaatgatgattcagttccataccctttttgtcacagtatactatgcaattttatatggacacattaacttttgtttgttttttgagatggagtcttgctctgatgtccaggctagagtgcagtggtgcaatctcagatctcagctcactgcaacctccgcctcctgggctcaagcaattctcctgcctcagcctcctaagtagatgggattacaggcgtgcaccatgtctggctaatttttgtatttttagtagagacgggattttgccatgttggccaggttggtctctttactccccatctcaggtgatccgcccaccttggcctcccaaagtgctgggattacaggcgtgagccaccacgcctggcctgtatggacacattaacttctctacaactatcacagaaatgtcaaaccccaggttcaaacccagtatctatggccataataacctctacttattctaccttaagcctaggtataccatccaatgagaagatccttaagtgctcctttagattggtgttatcagagtttcaagatataacacactctaacatcgggtggggcaagtatcctactagaagcaatattatacttagaattcgtgaggtactgagggcagctgtggcgcagccctgagtttccactatgccacagtggtgcataggatgatgcagcctcgccctcctaggctcaagcgatcctcccacctcaacctcccaagcagctgggactacaggcatgtcaccaagcccggctaatttttgtatattttgtagagacagagttttgccatgttactcaggcttgtttcaaactcctgagctcaagcaatcctcctgccttggcctcccaaagtgctgggattacaggcgtgagccaccacacccagacattttaaaacttttaacataaattcagattacagaaaaagtgcatgaatacacaaaaaacacttcatattcttcactcagattctccaaatgttaacattttccttcatttgctttattggtttttcattcctttacccctgaatacttcagtgtgttttctcgtgacaagaatgttttcttctacccaaagcacaattaccaaaatcaaagaattaacagtgatctggtacttcaaaatacattttttttttccctgagacagtgtctcgctctgtcacccaggttggagtgcagtggcacgatctcggctcactgcaagctcggactcccgggttcacgccattctcctgcctcagccgcctgagtagctaggactacaggcgcccgccacgacgcccggctaatgttttctattttcagtagagacgagatttcatcgtgttagccaggatggtctcgatctcctgacctcgtgttccacctgcctcgacctcccaaagttctgggattacaggcgtgagccaccgtgcccggcagaaaatacaatttttgacagctcacgtttcatcccactcaaacctttttaggtgaggagtgctgctctgtactttcctacacgatgtgcattcctgtattgcggctgccattttcctaaggccaactacatgacaggtaccattttttatggcctctgtaacataatcttcattaacaattctatgaattaaggtttttggggtttttgttgttagttttgttttttgagacaagggctcaatctgtctcccaggctggagtgcagtggtaccatcagggctcactgcaacctctgcctcccgggttcaagggattctcctgcctgagcctcctgagtagctggggactacaggtgcgcaccaccacgcccagctaatttttgtatttctcggtaaagacaggttttcaccatgttggccaggctggtctggaactcctgacctcaagtgatccgcccacctcggcctcccaaagtgctgggattacaggcgtgagccaccacacggtcccacgaattaagttctattatcaatttcattttagaagtgaggatccgaagtctcaatgaggggaagtgttgccccagatcaaaaggttaataaatggcacaacaggaattcttatcccaggtccctttagctccaaagggcaagctctcttatatccctaagccgagaagcatctaactgtacaataaggactggcatatcacaaaaattatatttctttctctactgtctctctagatggaacttttcaaaggtgatggaggtcttatttttaataaaagcagagccaagcatcagagctggttcttaactcaagatccaacatctagtgtttgttctactgggggagaaggagcttcaccagaagacgacagacattccagggtcccagccccagagatttgattcattctgtctactgtgaatgggccctagaatgtcgcttttaaaacctctccagatggacctgacgattaggcttgggatctaccgccctcgcctgcccccatacctcagctgtttcataactgctcccagaagaaggaagggcagggagggctactctcatgttacaaagagccggagagggcaaatgactcgcccaaggccacacagcttagaaaaacagcggcgcggggactagacgccaggtctcccaacctccactccggctcggcgtcccaacacggaggaagccccgagactgccacgcttagagccccctcctccaggctgtccaccccgaggcctccgcgctctcggagagaccgcactctcggagagactcgggagagaaagacgaaagaccgcctttggaggccgaactcagccatgcctccccagttcccagcccagcacagaggaagctgcggggtccggaagaaaaaaacgcacacaggcggcggccccaaaccgttgccgcccacttacctcagctctggctttacactggtagccgccttcccctctgcagccgaaaccaacttccggtctcctccgggaagaagccaccgactctgtccttgattggctgtaagagctgtcctttaacgaaattctagctccgcctcagaccgatccctcgctgttgcgcctacgtatgtttgactcctcccatccacccgttactgacttttaaaagtcgtagctgagggttccgtttcttcgtttctttttgaattaaggcataaaattgaacaagacaccttattgctttattttttatagaccccttattgaccagaaacaatcttatgttttaatgtttaacatgctcttgtaagacttaacgtgaatttagaaatttatgacacgaaaataacctccaaaagaaacgcttgctattgcgcctgcgtatattccacccccttccccattaccactcttttactgacttagtcgctgctggtagttccattccttttgtccttttttaatttaacgcatacaattaagacgtcttacatacaaattcgaaaatatagacatgcagggtttttttgttgtttttttctttgagacggagtctttctctttcgcccaggctggactgcagtggcgcgatttcggctcgctgcaacttcagtctccgggattcaagcgattctcgtgcctcagcctcccgaatagttggggtttcacctatttttttttcttttttttgtatttttggtagagacagggtttcaccgtgttggcgaggctcatctcgagctcttgatatgaagtgatccgcccgcctcggccacccaaagtgctgggattgtaggcgtgaaccaccacttccggactcccccattttaaatccctcgcacgtatcaatttatttcctgaagaaatccatctacgttgagcataacccaatccagcttttctcctcaccgctgaccccaatgtatcctgcaccagtgacttccaatggtcgttcccagtcctcattttactccatctgtcagcagcatttggcacatttgattaatggattgccccaggactcagttctccaaccacttctcagtcagatatcagctggatgattacatgcaggccctggaacaccgtttcctctgcacttcagaccctcatatccagtggtgacagacatctttccccagttgcactttactcaattgcaaatgttcaatcgaaggaatcacctttttctcctttctcacataccccaccgaaactaccataccagccttttgcattagatctatttaaaaataagtaaataaagttccaaatatgactgaccaccgttcccactgctatggtcctatgccatgccaccattatctctcacctggacttctttgattttttgtcctcccttagtctatttaccacaccttcttaaaatataagaccggtcttatcactcctctattcaaaatcctccaaggctttctatgacttttagaataaaatctgacatccttcccctggcctatatcacaggccctacaaaattgccaagtacatcccggccttggggccaatgcatttgcctggaactctttgcacagatattgacacgtctcatttccttctttccttttttttttttttttttttttttttttttttgagacgaagtcttgctctgtcacccaggctggagtgcagtggcccaatctcggctcactgcaagctccacctcccaggttcacgccattctcctgcctcagcctccccagcagctgggactagaggcacacgccatcacgcccagctaatttttttgtatttttagtagagacggggtttcaccgtgttagccaggatggtctgaatctcctgacctcgtgatccgcccgcctcggcctcccaaagtgctgggattataggcgtgagccaccgcgcccggcttcatttcctcaattcattcaggtttctggtcaaatgtgacttcaaagagttcttctggggttacactactctatgcaaaatagcgcatccctaatctttctcttgggagatgcccctgaaacccttactatgtattatctttttttcatagaacctctcatcatctgaaatcatcttacatagtatatttatgtattttattgcctttcttatccatcaaaaatatcaggtttatgagcatgggacctttgtttcatttactgctgttgtgtttgaacctacatacaacggtgcctgaaattggcaaatactcaataagtgtttattgaataagaaacaaaatgaatacaatcatcactttcaaataaattcatagcgtggctttggtggttataccacagtctctttagccagatcctcattgtgttaaattatttttctccaaatttgatccagtgtaactacacaggatgatgagatcccagtacatatatgtttgtgcatgtgtccaattttgttctttgaaataaatttctagaaatagaattactgggcccaaaggggcagtgtcttaacagttagtagcagaatcaaggctagaatcttggactcttgactatcaatctagtgttctttccaataaacttcaaatgaataatggatatgaagtccatatcatgagaagggctagtgacaatatgatgtgtgttaaacatttaattatatgactatattggcaaaatctcaatggaaagcttattacttaaagatgcctactacagcttaacaaggaatatgctcgttgaataaatctgtatattgtgtgtctgttgtgccggcactggtctagaaggctaaaaagacagacaaaagccagtggggcctttgaaaaaagtgttctttctagaaggtgttctagagagacacagacaagaagtatacaaacaagtaaaaacttcgaatagtggtaagggctatgggggaaagtataatacagattaatgtgatagtgacgtgggttggggaatagctactttacacagggtggtcagggtagcctctcacagaaggttaactttggaaacaaaatatgaaggagtgaattctgcagagatctgggagacagcaaatgcaaagagcgtggggctgccatgatctttctgaattagagagaggaaggcagcctgtgtgctccatagctagtgagcaaagaaagaaagagcaggggagatgaaatgggcaaagacacacggtaaccgacttcttgcctcccttaggatcttggcacattataaaaaacatcgctgtcatttgaacctaaattacaagcagaaatttttagtttccaccctattgattttttaaaatgtagatttattgagggatactttacatagaataaaattaactctaggtgaatagttataagagttttgataaatacatactgacataaaaccactaccacccggattaagatgtagaatatttcatcaccccaaacaacttttttttatttcaattccttccctttatccccatcctctagtaaccactgatctgatccctgttcatatagttttaccttttgcagaatgtcatataaatgaaattagaaagtatgtagtttttggtgtctggttcctttcacttagcataatacttttgaagtccatcaatgttgttcaatgtataatactttgttcctttttacagataaggaatattccattgtatgaatatactgtaattcatgtatccattcactggttaatagacatttgggttatttcagtttgaggtgattcttaacaaagatactataaacattcccatgcaagtcaattgtatggacatatgttttcatttcttttggataacaacatagtgacaaaattgctggacattataataattatatgtttaactatatgagaaactaccaagcagttttctaaagaggctgcttatttttcatttctcagcaatctatcggaggtatagttgccctcaatctgcaaattggtgttatccttttaatttttactttttgctattctaatatctgtataatgattttaatttgcatttccttagtattgggtatctttcatgtgtttactggccatgtatatcttttctttggcgaactgtctgttcaaaatttttgcccattttttaaattggcatgttttcttactattgaattgtaagggtgcacacacacaaatacacacaagatataagtccttgataagatatgtcttttacaaatattttctcctagtctgtggttaatcatttcattttttaagtgtctttcagcaagcagagtttttttattttgatgatgacaagtttatcaattattttattttatggctcatactttttgtgtcctttccaagaatctttgcctaactcaaagtcaaagatttttcctctgttttcttctacaagttttctaattttaagttttacgtttaggtctatgatccttttggggttaatttttgtatttgatgcccagtaagggtcaaaactccttttatttgtttatttatgcttatagaagtcgaattgttacagcaacttgttgattttgttggccttactacctctgtcattggtaggcaggtttatagatagtaatccctgagcgtctgttagtcagttacattgtatctttggcttgctgatcagcccggcagaatcattggaagatagcaagtaaaaatttttatctccaagctgggcatggtggcatgcacctggggtcccagttacttgggaggctgaggtaggaggattgcttgagctgatatagcgccactgtactccaacctgagcaacagagtgaaactctgccaaaaaaaaaaacggaaaaaaaaaggctgggcatggtggctcacgcctgtaatcccaacactttgggaggccgaggcaggcacatcacctgaggtcaggaattcgacaccagcctgaccaacatggagaaacctctactaaaaatacaaaattag

SEQ ID NO: 287 - DNA, 24519 bp, Homo sapiens
  2nd Promoter of HAVCR2
ttgtgggcacatacaggtccttaaaaagcactgtttgattgcaaagagagaaggagcaaatacaagatgctgagcatcagttgtgaatacacaagcaagaaactgagtcaaataaatgtgggctcctggatatgccctcaagtaattttttttttttttttttttttgagacaaggccttgccctgtcacctaggatggagtgcaggggcatgatcacagctcaatgcagcctcaacctactgggctcaagtgatcctcctgcctcagcctcccaagtagctggaactacaggtttgcagcaccatgcctggccaaattttaaaaaatattttttgtagagacagggtgtcactatgtggcccaggctagtctcaaactcctggtctcaagcattccttccaccttggcctcctaaagtgctgggattacaggcatgagacactgtgcccggcctcctcaaagaatttttaagtcattgctgcaagcttgccttctagtggtttttcttttatgagggaatttcgctcttgttgcccaggctggtgtgcagtggcgcgacctcagctcactgcaacctccacctcctggattcaagcgattctcctgtctcagcctcctgagtagctgagactacacaggcacacaccaccatacctggctaattttttgtatttttagtagagatggggtttcaccatgttgaccaggctggtctcaaacccctgacaggtgatccaccctacttagcctcccaaagtgctgggattacagacgtgagtcactgcgcccagccagtttttcttttattctgagaaggtagcagggacagtaaaattgaggtttattaaggtatggctttatttatagttaaatacataaaactggctgggcaccatggctcatgcctgtaatcccagcactttgggaggccaagttgggcggatcacctgaggtcaggagttcaagaccagcctgaccaacatggagaaaccctgtctctactaaaaatacaaaattaggccaggtgccatggctcacgcctgcaatctcagcactttgggaggccgaggcaggtggatcacctgaggtcaggagttcaagatcagcctggccaatgtggtgaaactccgtctctactaaaaataaaaaaattagccgggtgtggtggctcatgcctgtaatcccagctactcggaaggctgaggcaggagaatcgcttgaacccgggaggcggaggttgaggtgagccaggatcacacccttgcactccagcctgggcaacaagagcgaaattctgtctaaaaaaaaaaaaaaaaaacctcttcactttgaatattcctgactggtgtcttgccatatttaaagagataaatttaaatactctttcccattaggattgcaatggaagcaagaagaatggtattctagggagatgaagaatctttgaaccttccacagggtagacagttgtgaaattgaagaataagagggacaaaatgctaatgtttcttctttgtggttttcaagctcttactatatgccaggcactttacacacatcatgtcagtccttcattacagcaggcctatgaggttagaactgtcatcatcaacatgttacagcccaggaatctgaagctaagggaacttaaggctttttaccccaaggacaaggtgggcatgaaggaagtctaaagccatgatttcccctccaagttgagtacaacatagctcacaaaaaaagttacttactgttagatttatatcagggaggctccccagtgtctgtgtctctgctataaaaagagagagagagagagagagaggaaaaatagccaatagtatagttaagaacgttttcttttatctaagtttttaaaaaatcttaatgatgcctataatcctatttgaaatgaattctactccgtacttgtcacaataattaatggagagacagacaaaatttactgaacacccaggaatcaactttaggatggccacattttttcatctagataatgaaccgtactgttttatgaaatagagacttctgccaggaagtcctacattaaatatgtgctttgtttttttcacaggaccctaatgagttctacaaacatctagcaatattgataagactcaggcattatttatttatttatttatttagacacagaatttcactctgtcacccaggctggagtgcagtggcataatctcagctcaccgcaacctcggcctccctggttcaagcaattctcatccctcatcctcccaagtagctgggactacatgcatgcaccaccacgcccagctaatttttgtatttttagtagagacgaggccatgttgaccaggctggttgtgaactcctgacctcaggtgatctgcccacctcagcctcccaaaatgctgggattacaggtgtgaacgaccaggcttggcctcaggcattatattctaattagattttaaaagacaacaaaaattcatttccttcttttttgtttttttgagacagtctcactctgttgcccaggctggagtgcagtggcacaatctcaactcactgcaacctccatgttctttttcttttttttctttttgcgagacagaatctcactctatcacccaggctggagtgcagtagcatgatctctgctcactgcaacctccatctcctgagttcaagcgattctcctgcctcagcctccctggtagctgggactacaggggcacaccaccacacacagctaatttttgtatttttagtagagacggggtttcgccatgttggccaggctagtctcgaactcctgacctcaagtgatccacccgcctcggcctcccaaagtgctgggattacaggcgtgagccaccgtgccgtgcccagcctccattttcttaaataagttttgcatttactcatgagaagggagacagggttgccaacaaatgaaaataatcactgtggtcacaatgtaataggagccaggccttgtgctaaataaactctttcagtgaagaagctcattttagagatacttagaagcacttactttagaactacgcttctaaagtagagactgttagtcccattgcacagatgaagaaactgaaaattagggaagtgaagtgactaacccaaggtcacatgacttagcaaatgacaaaatggccttccaatttaggtctgcatagccttaaatgcacattcttaattatactgccttcaccagcccttacctcagtgctgtcattatgaagagggtcacgttgcccagccacccactcaccatctttccttcctgttcatttgtttatttcttcatctgctgatccattccatgaatatgcactatgcccttactctaggcacaggggacagagcaggaaacaagaggggcacaggccctgacctcatgaacactgaattctaaaaataagtacattgccagcttttggaaaactaagcatgcttactcatttttatggctgagtcagagatgttgaaacttcttaaatgtcactgtcaccttctggaagccttaatgtgtataaagggtttgactaaatgctggtttagcaaactatagtttaaatattataaaggcatagcctcagcctaaaattattgaagaaaaaaagattatgttccaattacttttgccctaattaccagaaaaaaatttaaaatataaaaaccacaggcctggtgcagtggctcacacctgtaatcccagcactttgggaggccgagggcaggcagatcacgaggtcaggagatcgagaccatcctggccaatatggtgaaaccccatctctactaaaatacaaaaaattagccgggcgtggtggtgtacgcctgtagtcccagctactcaggaggctgaggcagtggaatcgcttgaacccaggaggtggaggttgcagtgagccgagatcacaccattgcactccagcctggtgacagagcaagactccatatcaaaaaaataaaaaaaagaccctcatcagtacaactgctaagtaaacatgaatcttaagtgcacataagattttaaatgtaaatccagtttcagactccttataattatttttcttgataaaaatggtaaaactaactttttaaaaacttcattttgctatgaaaatgatcagtaaaatcaagcactgttgtgtcattacagctttttttcacacagatttggccaccaaccaagatggatgggacagttgaagggagtggcaatgttctttctggagaaaccaagatttgcctggtggggcaggtagcagcggaggtgagatgtgatggccttaacagtgtataaatttagtagttaccatctatttggtacttattaggtgccagacatggtgcttagcaccatatacatacaatctcatttaatcctcaaccacaataagtaggtactactattttccccatttttcagatgaagatactgagtctgagagagccactttgcccaagatcacacagctattaattgggaaagctaggatttaaagcagatctactctagagctgaggactcacctgtgacccagtccttactccttcaggtagaagacaagttgcatttgttctgtgttcaaattccaggcccttggatctcttacttttaaaggctctactccattttttttttttttttttctgagaaagggtctcgctctgttgcccaggtttggagtacagtggcaccaactcggctcagtgaatcctcaacctcctgagttcaagcaatcttcctgcctcagccctgccaagtagctgggactacaggcacatgccaccatgcccggctatttttttttttttttttttttttgggatggaatctcgctctgttttccaggcttcaggacagtggtgagatctcggttcactcctcccaggctcagacaattctcctgcctcagcctcctgagtagctggaattataggcatgcaccaccatgaccagctaatttttgtatttttagtagagacaggggtttcaccatcttggccaggctggcttaaactcctgacctcaggtgatccatctgccttggcctcccaaagtgctgggattacaggtgtgagccactgcactcagcctaattttttgtattcttagtagagatggggttttgccatgttgcccaggctggtcttgaactcctgagctccagtgatctgcctgccttggcctcccatagtgctgggattacacatgtgagccactgtgcccagccccatttttatattaaatgctcccacatcccacatttagagttggtttgccagcagccaatttacataatgttacatattatagacaaaccattaaatattcattcatttcaattttttattttattttcctatttaggagctactgacctatttttggttgtttcaatattttttctcagtcaggcccttgagaagctcagaggttcgaggtattattcctatattcccatttttgttgccctagagggaaggaactaacaaacaaaaactaaagggaaggctgggcgtggtggcttacacctgtaatcccagcgctttgggaggccgaggcagagggatcacctgaggttaggagttcgagaccagcatggccaccatggtgaaaccccgtctctaataaaaatacaaaaattagcggggcgtggtggcgcgcgtctgtaatcccagctacttgggaggctgaggcaggagaatggcatgaacctgggaggcagagtttgcagtgagccaagatcgtgtcattgcactccagcctgggtgagagagtgagactccgtctcaaaaaaaaaaaaaaaggaaagaaaaactaaaggaaagaagacttctgtctgtggtagagacaagtataaggaaatgcaccacctcgacagggagtgaactccgtctacagcaaatgcccattcagtggtgatgtagtaaaaagtactggccgggcgcggtggctcacgcgtgtaatcccagcactttgggaggccgaggcgggaggatcacaaggtcaggagatggagaccatcctggctaacacggtgaaactctgtctctactaaaaatacaaaaaagaaaaaaattagctgggcttgatggtgggcgcctgtagtcccagctacttgggaggctgaggcaggagaatggcgtgaacccaggaggcggaacttgcagtgagccgagattgcgccactgcactctagtctgggtgacagagcaagactccgtctcaattaaaaaaaaaaaaaaaagtactgaagcacaggatgggaaagtgagactaaatgacccttgaagtcccttctagcactatggttgtaagattctttaaaatataacaatggcatacaataagtatctggtataactttattattttctgtccccaccatatttagtttcctctctaattgcataaaagatgttggctaccaatcactaaagactaaccaaagactgaaactttggagagctaaaaccagtaactatagtaataataaacagttgagtgctttttatgggccaggtactatgctgagcattttacatacattatcatgtttatacattacaaccacctcatgacatgggcactggaattatcctcattgtagagatgagcaaactgagcttcagagaatttgagcaacttgactgaggtcacagagctatcaagaacagctgaaattagaacccattccacctgtcactgaagtactttaaccacaatctcactgtgcctcctgatcttataatattaacgacaacagctaacatgtacaaattgtggtcagacattgggataaacgttttagacattttcttatttaaagcccataaggtgtgatttatgagatttatgacattatgaggtgggactcacctattaacctcattttacagaagaaaaaaaaaatggagctccagagagtttagaagagaccaggacactgacaagaaataccttaaaattaaccttcatgatcaatgtgacttgacttctgctttatgcccagtgttctcttctggagcaccctgagtacgtccttgctgaattacatgaagaatttaactattctttctgtggctggaatccagggaaggtgatgggctttattctagctagaaggcatcctagaaatcacctaatccaatgtgtcagttcccaaacacagactgacaccagttcatgaccaaacatcaccagtccagggtcagtcagaaaatgtggacaaagtaatgagcatttcattcaatttagttaatatttaagtaaaattaaagactataaagtttattaacttttttccagttaaaatttaagtaaaataatcctaagccagaccatctttttcccagcacaggtgtgtctccaccacttccctcttttcaaacactatttcaggtgcacggagatatccatgcctccactctcacactgttttctcatctttttttcccacattcaaaatcctctgaattcagagccagctaaagattccctcctctgccccatgcatagttacctgggccatgtcccctggtggtaagcatccttggaaaggctgcagtgaagtctctctgccgagtcggtgcaggggtgaccttggctaatgtcagaaacaacataaggatgaaaattatctgagagcagaaagcttatttcagggaatcaaaggggcagcaagaaaaaaatgcgaaagacaattaagaaagagaaatacaccctcagcttccaaacctgcctggatacctacgttgagagtgtatcacacacttcaaatgtttgacaaaggtaagatgcagtcatcattgttacattctgattattaatagcggaactaacagccacacaaatggccataattacaggttgaagactccttatctgaaatgcttgagatcagaaatgttttagattttgaattttttttttttttttgaaacggagttttgctcttgttgcccaggctggagtgcaatggcataatctcggctcactgcaacctccgcctcctgggttcaagcaattctcctgcctcagactcctgagtagctgggactacaggcatgtgcaaccacacctggctaattttgtatttttagtagagacagggtttctccatgttggtcagactggtctcgaactcccgacctcaggtgatccacccacctcagcctcccaaagtgctgggattataggcatgagccaccacgcccagccatgtttttatttttttattttttagtatctgcctatacttatgttccaatgagcttttcctttgaatgtcatgtcagtgtccaaaaagttttggattttagagcatttcagattttggtgcattttaggttttagattttcagatttgggatgcccaacctataaaggcttttaataaaatattatcacataaaatccttctaatggcccacatgatcggtattattgtcatattttatagaagaggagctcacagcgtttcaataacttgctcaggattatatagctagtaagaggcagagttagatgtaaactcagctctatctgggcacaaagtacatgttatagaaatcttaagtctgttcacctcccagcatacatgcataacccagcagttcaccatgctggctgcacctggggtaaaatcacctgaggtagactctgtaaaaagctaatgcttagcatctacctccagagatgctgatttctctggtttttggtagtggggttttttcttctgctttttaagagataggggtagccacagtatatcagccaggctggtctcaaactcctgacctcaagtgatcctcctgcttcagcctctcaaagtattgggattataggcatgagccactgtacctggcatctatagttgtttaaaaactctctatgtgattctaatgagagtcagggtctctaaccactgatctaggcctttcatcccatctatacattccacccatgagttttggcttttcttttcttttctttttttttttttgagacagagtttcacccttgtcagccaggctggagtacaatggcgagatcttggcttaccacaacctccgactcccaggttcaagtgattctcctgcttcagccccccaagtagctagaattacaggctcccgtaaccatgcctggctaattttttgtatttttagtggagacaaggttttactatgttggccaggctggtctcgaattcctgacctcatgatccaccggcctcagcctcccaaagtgctgggattagaggtgtgagccaccacgcccaggcacacccatgagttttaaaacagagagaaggtgttaaatatcactgagcatcaccaatggggcctgttaaactttaggtcttagtggccctcctccagggctataattagggaagtcagagatgagaacaatcagtacctttaatatgatccacagataaatcttattcataaagatggcatgcaaatgtccactcacctggtttgatgaccaacttcaggttaaatttttcatcattcattatgcctgggatttggatccggcagcagtagatcccactgtctgctagagtcacattctctatggtcagggacacatctcctttgcggaaatccccatttagccagtatctggatgtccaataattcacatccctttcatcagtcctgagcaccacgttgccacattcaaacacaggacaggctcctttgccccagcagacgggcacgaggttccctggggcggctggggtgtagaagcagggcagataggcattctgaccgacctccgctctgtattccacttctgaggaccctgcatagagagagaaggagagccaagactcaagcggtgagtgaggttactccatttcaggaaaactgcaagccatgtcttacagaataaagaggaagctactgctgcagtcctgtttggaggatgattcgctgtgacaatgcttctcagatgtgaaggccatcagaatcactgggaagccttgcgaaaacacagattgctgggctcaactgctagagttcctgactcagttggcctgtggtagagcctgagaacttttatttctaacaagttctcaagtgttgctgaagtggctggtctcagaacctcactttcagaaacactgccctaggagagaattgtggcccaattctgtgaacacgggagaacagggctgatggaaacagacaatcagaaaattagtcatggtcagccaggaaacggcccgcccatctgggctacttgcttgttcatcaacaaagggaggctctcctaacatacttctctttttaagcagcaagtgcacagtaaatacaaacccttggttaaataaggatcttgtgtatttgaaactactcatggagttgttttaaggtttaaagttgtgaaaagaaattaaattttgggaccccaaactcattcagtcaaagggaaaagtcaagctgggaactgggtcacagaaacctgcctcctctttttgattcctgaataagatggctacaggatgaaaggctgcatacctcccccatattttgcccacaaggaaattcctggtcagctgtgcaatgcagattgatagctcatctttaccggtgcggtcaccctggccagacacaaatgcgttatctgattgtttccctaccccattttgtctgtgttatctaatgtaaaatgcagattccccatatttttcctctgccccccccccttttttatgtgaaaactgagtgcttctcaatatcccaccttgtcccctttaaatctggagccctcaaaatcatcttctgagaaagtcatagacctgtctctcaggtgcctccttaactttggcaaacaaatctcctaaaatgattgagacttgtctcctcattttcctcaaatgacaaagttaattccattaaaaaaaaactatatatattttatatatgataaaacattcattatatattttcttttgattttttatgtcccctttgttttcatatgactcaactacagtaaaaacattcaaacactatcaaaggtgtatgaaaaagtggccgggcacacggtgggtcacgcctgtaatcccagcactttgggaggctgagatgggcagattacttgaggccatgagtttgagaccagcctgaccaacatggtaaaaccctgtctctactaaaaattaaaaacattagctgggtgtggtggtgcacgcctgtgatcccagctactccggtgcctaaggcaggagaatcacttgaacctgggaggcggagattgcagtgagccaaaatggtgccaccactgcactccagcctgggcaatagagtgagactccatctcaattgaaaaaaagaaaaagaaagaaaagaaaaagaaaaaaaggaaagaaaagaaaagaaaaatatgccttactctcccaactctttaccattccctggttccttttcctagagcttatacattaagaaatgtccacatattcctgctccccgacaatgcacacacacaaatagaagcctaatatatgcattattctgcaactttttttctttaataacattataattttgagacattctataccagtatgttttgtcagactcactgtttgtatcatgattatatcacatttatttacccactccctcatcgacggacatttaggttgcttccaagcttttgctattacaaacaacattacaatggccatccttgtatctctcccttgtcctctgtacagcaccattatgtcattgtaaatatccatgccgagacttacttgtaagtagtagcagcagcagcagcaggacacagtcaaagggaagatgtgaaaacatggagcttgcagaagaaaagtcagaggacacctctgttaggcacagttttaactctccaaatggactgggtacttcttccaactgtctactccacaatcacatgagcagtagccgcccccactgagtgctagctcagcacacccgggtgtctgattgccagtgattcttatagtaacactgccaggtctacagtcacattaaaggaaaccaaagttctctgtcatgccacactacacacatcctgtaagtgttctgatgtctgtcctgtgatatcaacaaagaggaagcaatacttcagtggaagaaaacgctactcagtcatggcacataaagagaaccctctaataatgtctcagatgagatacacctgaaatggagcatgtccgagtccatctgactagcggggaacacaaagtacagatgcatcatccatggattcattcactcaaatcagtcccttcatcaggcctgtgaccaaagtttatgaagcccctactttgcaccaggcactggactaggaagtggaacacaacagtgaatggcatgttccttatcctcacatttacagaccatagcaactcccagcataagcctcactctcatccttcttctaacacagattaggttgtatcctataaccttgctgagtctcagtttcctcatttatataatttataaaatgagaaaattgtattagataatacatgcatggctctctgttctaatattctgactttgaccttcaaacttccaactcttcaatttagaaaaaacatgttccttttggcaacagttcctttcctctactctgagtagaattaaggggatcttggtatcctgtttcatctcatgcatacaaggtgccccctctcccctaccccaagaggctttggccatgaatgatcagaaagtgttgagttccagccacactcccataactgaggtaacagcttagactcacgtagcctcagctctgggagtgtgacctttatctggacaccttaaaagcaaaagcttttttttataaaagggaagtgagctcacaggctgagtggtttctgaaaagccagtggccttcctctatgtcttgccttcctgagtttctttgtcattcacatttatgccattaaatgcattgggtataaataccaaatttgttcaatataaacaaatggcatttaatataaatatgcaacttgttcaatgtgtgtacttcccatagcattgcagagtggcagttactcaagagatcataatcaatttctcattttattttattttatttttatttatttatttatttttttgagatggagtttcgctctttttgtccaggctggagtgcaatggcatgatctcggctcactgcaacctctgcctcccgggttcaagtgattctcctgcctcagcctcctgagtagctgggattacaggcatgtgccaccaccccggataattttgtatttttagtagagacggggtttctccatgttggtcaggctgttcttgaactcccgacctcaggcgatccacccgcctcggcctcccaaagtgctgggtttacaggcatagccaccgcgcccggccaatttctcattttatagacaaggaatctgagacttcagaaaattgatttgccgaaaggcacatgattggtgatttagaatgagagcataagccccctaagtgacagattttttccactataaattatgttttattaatttaatgtttgtcttcccacataactaataaccagcaaatgaccatattcaagcataaggtagaatagattaaatatggggtctggggttatttttattagcagcatgaacttggtcaaggctcttaaaagcatcagccctcagtttctgtgttttgttttgttttgtttttgtttttgttttgagacagagtcttgctctgtcgcccaggctggagtgcagtggcgcgatctcggctcactgcaaactccgcctcctgtgttcaagcaattctcctgtctcagcctcccaagtagctgggactaagagcgcacaccaccatgcccggctaatttttgtatttttagtagagacagggtttcaccatattggtcaggctggtctcgaacttctgacctcaggtgatctacctgcctcggcctctcaaaatgctgggattacaggcatgagccaccgtgcccagcgatgttttgtttttaccactttgttttctgctcatttctagaattgctactgagaccagctttataaaacattaacaatttattagttcattaaagtctagatatgaaggggtctagagatctcctttaactctcttgtgtgtgtagggagctggttctgaacattttcatgttcacttaacttttatttcctgtttattttcttaaaaactttagataatacattcaaatagttaaaaagtaaaaggaatataaaaagctcaagaagccttgatcccatgatcccatccttccatgtttacccccatttctcccacctatgctataggttttcttttttttttttttttgacatagagtctcgccctgtcacccaggctggagtgcagcgtcacgatctcagctcactgcaacctgcgactcccaagttcaagcgattctcctgcctcagcctcctgagtagctgagattataggcacctgccaccgtgcccagctaatttttgtatttttagtagagatgggttttcaccatgttggtcaggctgatctcgaactcctgaccttgcaatctgcccacttcagcctcccaaagtgctgggattacaggcttgagccactgcacccgaccaggttttcattttcataagtttcttgtgtatactcccaatgcaaacccaagaaaataaaatatatattctcatactctcttttcttagacaaaataccatataccttttttgaaacttgcattttcctattgttatttgctgaaatatttatttttaaaattttatttattttatttattttatttttatttatttatttatttattttttgagatggagtttcactcttgtctctcaggctggagtgcaatggtgctatctcggcttactgcaacctctgcctcccctcagcctcccaagtagctgggattataggcacctgtcaccatgcccggttaatttttgtatttttagtagagacagggttttaccatgttggccaggctggtctcaaattcctgacctcaggtgatctgcccgtcccagcattccaaattgctgattacaggcaggagccgccgcacctggccctttatttttttttaaatttgttttaatttatttttagagacaagggtctcactaggttacccaggctggtctcaaactcctgggctcaagggatcctcctgcctcagcctcccaaagtgctgggattacaggtgtgagccaccatgccgagtctgctgaaatatttttaaacgaatcccagacatcgtgctatttcacttttacgtactttagtgtgcaatcttcctttttaaaaaatgggcattctgaagccgggtgtggtgactcacggctgtaatcccagcactttgggaggccgaggcaggtggatcacctgaggtcagaagatcgagaccagcctggctaacacggtgaaaaccccatctctactaaaaatacaaaaaattagccaggcatggtggtgggtgcctgtaatcgcagctacttgggaggctgaggcaggagaatcgcttgaaccagggaggcagaggttgcagtgagccgagattgtgccactgcattccagcctggacaacaagcgcaaaatttcgtctcaaaacaaaccaaccaacaaacaaaaatggacattctgctaatataatcataatatcattatcgcacataacaaatttaatgatgccttagaagcacctagtacttcagtctatagccaaatctccctgattatctcaaaaatgtcttttttcaatcagtttgtttaaatccagatccaaacaagtcccagcattgcatttgtttgctatgtccctcaagtctcttttaatcgaagacagtctgccctccacccccttgccattggttatacaaaccagttatacaaaccaggttttgtcctgtgaaatgctccacattcagggtttgtctgtttccctgtggggtcatttacattattcctcttttcttcgaatttgctgaaaatgaaagtttgctctagaggtttagttggaacgtggtttgacttcttggcaaaaacacgtcacagctggtgccttgtgcttcacatttcatcacaattgtctggttgctccacagcatgcaaccttcttttttaaatgtatttaaattttttttttttttttttgagacgaagtcttgctccatcacccaggtcagagcacaatggtgcaaactcggttcactgtaaactctgcctcaagcagttctcctgcctcagcctcctgagtagctgggattacaaacacgagccaccatgcccagcaaattttttgtatttttagtagggacaaggtttcaccatgttgaccaggctggtctcgaactcctgaccttaagtgatccaactacctcggcctcccaaagttctgggattacaggcatgagcaaccgcgcccagcctaaaatcttttgtttcagctcatgtagaatgtcctcattcttttttattttttcgctctgtccccaggctggagtgcaatggcgcgatctcggctcactgcaagctctgcctcccagattcatgccattctccagcctcagcctcccgagtagctgggactacaggtgcctgccaccacgcccggctagttttttgtatttttagtagagactgggtttcatcgtgttagccaggatggtctcgatcttctgacctcatgatccgcccgccttggcctcccaaagtgctgggattacaggcgtgagccaccgcgcctggccgaatgtcctcatttttttattacagctacatagactccattagatgaactcactgggccaggcacagtgtgcatagagtgtaactctaattatgcaaaagttcataaaatggaagttagagccagatcaggagacaggataatatgggttatttagatggcagcatccggaaaatctcagtccaactagaatcttccctacacaattgggaagtgcagtggagtagatactggggagtaaccacaatgaccacttaaggtggggaccctatatgtacttaaattgagttgataattaacttggttaaatcacatctcaggttacatagacctaactgagattagttcaaaattttgcaaaggaagaaacaggttgaatattaagggtaagaggttaaattaagcaattgtgagccagatgttctgacttccagattgtaactagccacgtgagttcccatgaagggtactgtcaccttgtgtgtttgtacagtactttaaaaacctttttaaaaaattatataaatcatattcactgcagaaaattttgaaaaatacgaattaaaaaataaataaataaaacaaatgttgtcataatctcagtaccatgaaatagccactttcaacttaatgagtcttctttcagattctttttttttttttttttgtagagatgggaatctcactgtgttgcccaggctggtcttgaactcctgggttcaagtgatctgcccatctcagcctcccaaagtgctgggattataggtgtgagctactgggcccagcttaagttaactttcaacacttttgccctcctcaccaggtcccagcactaagagggctacgtcagaccaccaagatcctgggcatacctggaagaaacttcaggtttttcagggtcttcagaataacgtgtttacaaagataaataaatttcccctttgctattgactacctctcacagcatgactatggcgtgttcttatattgattttgatgcacccatatgccaacaaaactctcttaccaaagactccatacattattatgctgccaatgagagaaaacccaactcaagctggcttcaactataaagtgaatttattaactgacattatggaaaaatccaggttcaggcaaggcttgattcagtggctctcagagaggtcaccaagaacctagtttctgactgatgttaacattcagttgcctccagggctgtctcttttctcagattctacacagtgcccctctcttgcacccacagagcacacatctgtgtgaatcactcccctattggttaagggatttatactctttcaaaggcccaagtctgggtctgagtcacagactcattcctgaaaaatcactgtccccaaagggtcaaaaagcattaataggcttaggcctgggtcacctccccacacttcatgttctgaaatgagagaagagtgattcccctaaataaaaactgcagtgcatttcaggaggagagacagaagttggacaacaaaaacaaacatccactagagaccccttacacaaaaagggaagaggcaggagatggggaaagaaactttctcctccaagtatatatggtttttttcttacctaaaaatgacattttactaatgcagcgttttttaagttacaaggacatgctcttcacaaccctgaagagatgataaagagctcctgtgtttatagagagttttttatttagtaaccatgaatggatgccagagagattaagcttgaggtcacactcaagtgagtgcaaggccagcttaaagccccttccaatatagaatacagtggcccaggaaggacaagtcagcattctgagctatcacaacatttatccagcaagtaattttttaaaaattattttagtgacagagtctctctctgtcacccatgctgaagtgcagtagtgcaagcattacttactgtagcctcaaactcctgggcttaagctcaatacttacagtttataagtacttacaaactataaatttatgctatgtaatgttctttattctgttatatttttccattaaacaatagtttaaccttaaagccataatgtgacatctacatatccattgttttataaaaaattaaaaagtctgatggtagtaatactggcagtgtcatggagcaagataaatacttatcttccctattcagcctcctgagcagctgggaccacaggcatgagctaccacaccctgtttgttatttttatttttgtacagaaggggtctcactttgttgcccaagctgatcttgagctccaggattcaagcaatcctcccacctcagcctcccaaagtgctgggattacaggtgtgagccaccgcacccagccttatccattaagtaacttctaagggaaattgatgctgctcctgcctgagtaactaaatgtctttcgagtagaggaaatggagaggggtatagaaatactacacccttaatagctcagctaggctcccaatgatgaaaatgaaaagaatgaaaaggggttcctcacccaaaaaattcagctgagctatgtgagttactgtgggaaatcttatctgcagtctcatcttgaaagtgaaggtcccacaacctcctacagaggccccactggtgggggagcagcatgagtggtctctcattctgagcatggtttccagtgtggcatcgcccttatctttctgtttgctggttattagccttttaccccgggttcagatagttaagcttatcatagtcttcaatacatggacgtactcatcgtcagtcccttgaggtcctttgcttgtttttgtttttgtttttttttttcactttactatttcccccgcattgtctctgacccacattctcatttttctcttctcaaaggcatccaccttacaggggaatgttgagcagctttcaaaagctcacattctcaccgacagtgagaactcttttgatgttctatgctgctgccaatatcagtaccatcaggctatttcattttttccaaaacaatggatatgtaatgatgtcacaatatggctttaaggtcaaactactgtttaatggaaatataacagaatataggacgttatataaacataaatttatagtttataaatactttgaagcaaaaactcaagtaactaggactccaaaaaaaaaaaaaaaaacactgctagtctccataagtctcttctattccccatgccaagaccatgtacttcttcctgatcacaaaatcttcccagcttggcacagtggctcatgcctgggaggctgaggtaggaggattgcttgaagccaggagttcaaggccagcctaggcaacagggcaagactgtctctccaaaacaaagtagctgggtgcaatggctcacacctgtaatctcagcactttgggaagccaagtgggaggactgcttgaggccaggagttcaagacctggacaacagagtgagatctcatctctacaaaaaaaaaaaaattatttataaaaatcttccctctctcctacaggaaatcaccctgaattttgcaattatagtcttttttatagctttaccagctatgtgtgtatcccaaaattatatgtatagttttccttgggtttgaacattatgtgaataaaatcatatagtctgtagtcttttgtgttttatttaagtcaatagcatatttgtgaaatccattcatgctgtttgtatccctgtaggttgtttatgtatttttactaaacagtttttctgggaatgaatatacctcatattctttgttcattctaatttatttatttatttatttagagacagaatcttgcgctctgtctcccaggctgcagtgcagtggctaagtctcacctcagtactacctctacctcccaggttcaagcgattctcctgccttagcctcccgagtagctgggattacaggtgtgtgctaccacgacaagctaatttttgtatttttggtagagatagggtttcaccatgttggccagttggtatcaaactcttgacctcaggtgatctgcccacctcggccttccaaagtgctgggattacaggcatgagccaccacacccggccacgttcattctactttatcttttgtttagttatcataaacaatgccattctgcacattctcatagatgaatcctggtacacaaatagagaagcttctctggactacatttctagagcagaattactgtgtcagaaggtataaacatcttgaaccttactagagaatgcctaattagtttctaagactcccagcagcagtatacagcaatttctttatcctacattctcagcaacgcttggtattatcaaagttggcttttttgtctttttgtttgtttgttgccaaattggtaaaggtataataacatctcactgtggttttaatttgaatcttcatagttattaataagttaagaatcttttgtttcttatttttatttttttaacttttttcattttttgttttttgaaacagagtcttactcttctgtctaggctggagtgcagtggcactatctcggctcactgcaacctccacctcccagattcaagcaattctcttgcctcagcctcccaagtagctgggattacaggggtgtgccaccacatccagctggtttttatatttttactagagacgtggtttcaccatgctggacaggtaggtctcgaactcctgacctcaggtgatccacccacctcggcctcccaaagtgctgggattacaggtgtgagccactgtgtctggccattttttttttctttttgagacagagtcttgctttgtcacccaggttggagtacagtggtgtaatcttggcttattgcaacctctgcctcctgggttcaagcgattctcctgcctcagcctcccaagtagctgagactataggcacccaccactacacctggccaatttttgtatttttagtagagacagggtttcgccatgttggctagcctggtctcgaacttctgacctcaggtgatccactcaccttggcctcccaaagtgctgggattacaggcatgagccaccgtgcccagtcaggatcctttattttgattaggaactatttggacttttttggacaaatgcttattcaactcttttgcccattttcccatcgagtttctatatttttcttattatgcaaataatttatatattctggtactagttatcttctgtttaaatccattgcaaatattttctcccacactgggcttttcactttacactgtgttttcttttttttctttctttttttttcctttttacactatccacgtggaaatatacggtatgttttcttgaacttccttaattttaatatagtaaagttgactaatctttccttttctgagtagtacattagtattagtactttttaagaaattctcctcttatccagagattataaaaatatttgactacattaacttaaatctttataattttgccttccatgcttaagcctttaatcttcctggaatttatttgtgcgtgttttatcccagccccatttattggaaatttcatcattttcccactactttgtaatgacatctctatcctatttcagaaatcacatagtgcaagatgactgactagagatgcctggcactcctctcccccaaaagaaaggaccaaggcaataaataatagctgagatttgaccagatgtcaaagggacagcactagagtacagtgggaaagtagagaggcacctgtgatgactagaaacccaggaggacactatgggtgcacccagcttctgcagcccccatctccccagcccagactggccaagaaacagaagagactttcccttgcaaggcaacagtaagtagaagaaccccagcagcccccactgccaccaaaaatacctacagtccttactacaggagaatcctacaaggtcctcacaagccctgagcccagttaggagaggtgtagggaattaatgcagctgtgtgctctggattgggatacaaggtatgcactccccacccctactcggtcccccaacctggtgtgagccaaactggtgcagcatagtgccatcttgagaccagagccacatctggagtgcatcctcctctgcgggccagtagccactacatctctccagctagggctccatcttcattctgccaagcccacacaggtgactaaatgtcacaaccccaactctgcagaggctgggcccaggattagctctgactctggccttgcccagcagggaaaccaacccctgctgctcacatattcagctagaaaaatagtctggcagtcctgcccccggcaaacccaccctaaagccagccaaactactgtaggccctcccctgagcaagagaggtccctgagccatccaacagctgacacatttgtaagctagcagggtggctacatgcctgcatccaaagcctgaaaaacagccctgtggcatctagcaccccctcctacaattgcagacatacctctagcctgcccaaaggccctgcaccccaaatcaggacctcagaaatagccctgttgactgcccatggcaggcgcatacccaggcagaacaagcagctgtgtgaccatgtctcaggcttagaaaacagcccaatgagccattcctggcagtcaagcccccaggccaactgagcagcttgggccagggaaacagccccacaggccactcctgtctggcatgctcccaggctgatcaagctgctatgtgcccatgtccagggcctaagaaatagccttgcaggctgctcctggcagacacacctccaggccggccaagcaactgtgtgtcccctcacatcctaggcctgagaaacagccccatggtccacccccaccagacacacacccaggccagctgagcagctatgcaccccatcctgggcctgagaaatagccctgtggtccacctttaccataccatatggccagccaaaaagccatatggccacatcccaggcctaagaaacagccctgtggaccaccctaaggagacaccccccaggccagcccaaataacctttactcactactcagaactaaaaaacagccccaaggaccatccccaggagacacacacccccaggccagcaaagcaaccagtgtactggactcaagaaacagcacaatgggccacccctggatgatcggccttcaggctagccatgaaacagcacactgacgcccttagttaaagtaaaagctctgtggtcccaaccctgatgagtgagaccccaagttggccaacccaccatgggcatgtaggcacactgacctgagaaataacctgaaataacctgaaagcccacttccagcagagctgcaccaccactgccacaaactctcttagcctatgccactgagacacatgcaaacatcactaacatggattacagctgaagaaactacatggacactgcactactgcatccacctagaaccaaagccagtgcaccccattgaaccaacactccaagaccatctatgcaaataagtcattgcctactaaacctactgcatagaattggaagaggcaaatgtttcactgacttgcatagaaatcattgtaaggaaaagcaagaaaacatgtctcttcccaaagaacacaatag

SEQ ID NO: 288 - DNA, 16753 bp, Homo sapiens
  1st Enhancer of HAVCR2
tgatccgcccgcctcggcctcccaaagtgctgggattataggcgtgagccaccgcgcccggcttcatttcctcaattcattcaggtttctggtcaaatgtgacttcaaagagttcttctggggttacactactctatgcaaaatagcgcatccctaatctttctcttgggagatgcccctgaaacccttactatgtattatctttttttcatagaacctctcatcatctgaaatcatcttacatagtatatttatgtattttattgcctttcttatccatcaaaaatatcaggtttatgagcatgggacctttgtttcatttactgctgttgtgtttgaacctacatacaacggtgcctgaaattggcaaatactcaataagtgtttattgaataagaaacaaaatgaatacaatcatcactttcaaataaattcatagcgtggctttggtggttataccacagtctctttagccagatcctcattgtgttaaattatttttctccaaatttgatccagtgtaactacacaggatgatgagatcccagtacatatatgtttgtgcatgtgtccaattttgttctttgaaataaatttctagaaatagaattactgggcccaaaggggcagtgtcttaacagttagtagcagaatcaaggctagaatcttggactcttgactatcaatctagtgttctttccaataaacttcaaatgaataatggatatgaagtccatatcatgagaagggctagtgacaatatgatgtgtgttaaacatttaattatatgactatattggcaaaatctcaatggaaagcttattacttaaagatgcctactacagcttaacaaggaatatgctcgttgaataaatctgtatattgtgtgtctgttgtgccggcactggtctagaaggctaaaaagacagacaaaagccagtggggcctttgaaaaaagtgttctttctagaaggtgttctagagagacacagacaagaagtatacaaacaagtaaaaacttcgaatagtggtaagggctatgggggaaagtataatacagattaatgtgatagtgacgtgggttggggaatagctactttacacagggtggtcagggtagcctctcacagaaggttaactttggaaacaaaatatgaaggagtgaattctgcagagatctgggagacagcaaatgcaaagagcgtggggctgccatgatctttctgaattagagagaggaaggcagcctgtgtgctccatagctagtgagcaaagaaagaaagagcaggggagatgaaatgggcaaagacacacggtaaccgacttcttgcctcccttaggatcttggcacattataaaaaacatcgctgtcatttgaacctaaattacaagcagaaatttttagtttccaccctattgattttttaaaatgtagatttattgagggatactttacatagaataaaattaactctaggtgaatagttataagagttttgataaatacatactgacataaaaccactaccacccggattaagatgtagaatatttcatcaccccaaacaacttttttttatttcaattccttccctttatccccatcctctagtaaccactgatctgatccctgttcatatagttttaccttttgcagaatgtcatataaatgaaattagaaagtatgtagtttttggtgtctggttcctttcacttagcataatacttttgaagtccatcaatgttgttcaatgtataatactttgttcctttttacagataaggaatattccattgtatgaatatactgtaattcatgtatccattcactggttaatagacatttgggttatttcagtttgaggtgattcttaacaaagatactataaacattcccatgcaagtcaattgtatggacatatgttttcatttcttttggataacaacatagtgacaaaattgctggacattataataattatatgtttaactatatgagaaactaccaagcagttttctaaagaggctgcttatttttcatttctcagcaatctatcggaggtatagttgccctcaatctgcaaattggtgttatccttttaatttttactttttgctattctaatatctgtataatgattttaatttgcatttccttagtattgggtatctttcatgtgtttactggccatgtatatcttttctttggcgaactgtctgttcaaaatttttgcccattttttaaattggcatgttttcttactattgaattgtaagggtgcacacacacaaatacacacaagatataagtccttgataagatatgtcttttacaaatattttctcctagtctgtggttaatcatttcattttttaagtgtctttcagcaagcagagtttttttattttgatgatgacaagtttatcaattattttattttatggctcatactttttgtgtcctttccaagaatctttgcctaactcaaagtcaaagatttttcctctgttttcttctacaagttttctaattttaagttttacgtttaggtctatgatccttttggggttaatttttgtatttgatgcccagtaagggtcaaaactccttttatttgtttatttatgcttatagaagtcgaattgttacagcaacttgttgattttgttggccttactacctctgtcattggtaggcaggtttatagatagtaatccctgagcgtctgttagtcagttacattgtatctttggcttgctgatcagcccggcagaatcattggaagatagcaagtaaaaatttttatctccaagctgggcatggtggcatgcacctggggtcccagttacttgggaggctgaggtaggaggattgcttgagctgatatagcgccactgtactccaacctgagcaacagagtgaaactctgccaaaaaaaaaaacggaaaaaaaaaggctgggcatggtggctcacgcctgtaatcccaacactttgggaggccgaggcaggcacatcacctgaggtcaggaattcgacaccagcctgaccaacatggagaaacctctactaaaaatacaaaattagccaggcatggtggcacacgcctgtaatcccagctactcaggagactgaggcaggagaatcacttgaacccgggaggcaaagtttgcagtgagccaagatcgcacaattgtcctccagcctgggcaacaagagtgaaactccgtctcaaaaaaaaaaaaaaaagaaaagaaaagaaaagaaaaatttcatctccagtccctgtttcttcctgatttttataagctcatatactgtatatggttttaacgatgcactttttttttttttctttctggagacaagctcttactgtgtcacccaggctgcagtgcaatggtgtgatctcggctcactgcagcctctgcctctcaggttcaagtgattctcctgcctcagcctcctgagtagctgggactatagatgcacaccatcacgcccagctaatttttttacttttatagaaacggggtttcaccatgttgtccaggctggtcttgaactcctcacttcaggtgatccacctgtagcaggaagagccgcagacaaaactcctcagacaccggattaaagaaggaagaggttatttattcagccaggagcgtcggcagacttgtgtcttaggagccaagctccccgaaaaagaaattctcggcctttttaaagacttacaactttaaggggtccatgtgaaagagtcgtaatacatcaagcaagcgtgggaaacgtgactgggggctacatgcatcagctaacagaacaaaaagttttacaatgcttttttcatgcagtgtctggaatttacagataacacaagtagtttaggtcaggggttgatgttattgttactttttttaactcctagggctgggtggtgttgccaaggttgtctggctatttatcttacttttgtttttttccaactttttgctttttctctctttcctcctgtcttgtgaactaggcaaggtgaggggaggaaggcagcaggagtagtagtggtctcctgccttatacccaccttgacctcccgaagtgttgggattacaggcatgagccaccgtccccggccttaatgatgcactttggatgagagtcattgctaatgtattttttttctgcagtctgcagtatagtttcaattcctaatcactatttttttgttgttgttacttcatggctgctaatgaccttatcactaaaacgtcaacaatccagatctgtgtgcagcacatgggtggggagagtgcttgtggtttgctttgcctacagcattttttcttaccagcagggggagcagcaaccttggcatttggaaataatccccagcttaaacttttctatgggaaagatttgtgtcttgcatattgggtcctcctgagttgttacttgcaggctgaagaacctaaaatgaatttgtaatcctacaaaaaggcaggtaagcccttttgaatttgttgtagctgttactattaaaatctacatttaccttatgtggaatttcaccagaggaaaaaaatagccatgccatcatcatacctgttctttgaattatcacaaaatatacccattacggccgggcacggtggctcacgcttgtaatcccagcagtttgggaggctgaggtaagtggatcacctaagatcaggagttggagaccagcctggccaacatggcgaaaccctgtctctactaaaagtacaaaaattagccaggcgtggctgtgtgtgcctgtaatcccagctactcgggagcccgaggcaggagaatcgcttgaacccaggaggcagaagttgcagtgagctgagattgcagcattgcactccagcctgggcaacagagcaagactccgtctcaacaacaacaaaaaataactgttttattgatttattgattgattgattttctatacactccctaaaggatctgggctctgtccgatccatttaagttcccgctttaagatccatctcaaagatggtcttctccaaaaggtttctctcagttcacccaaataaaaattacctctcaccaactcaaagcctctttcctttacttcttacagcactcctctagctgaagttgtaattatgcgcctgttttatttctatggctgtagctaagttcctgacttatctgggcatccccttaacaatccctggaattacctcacacatggccaatgttgaatatatttttgttcaaagacagatttgagcaaaagcaaaagaaagaagaaaaaaaatctcctgaatggtgtgtgtacaaatgtgaactacctgctttcagtgtagcttcatatcaggatcaagactaagtggaggtgtgtaaggaacacgcctcatgcacaaaattaaggaggagcaaactcagtaatcaagataaataatatcggctgggcgcggtggcttacgcctgtaatcccagccctttgggaggctcacgcaggagaattgcttgaacctgggaggcgggggttgcggtgaactgagatcgcaccattgcactccagcctgggcaacaagagcaaaactccgtctcaaaaaaaaaaaaaagataaataatatcttaacacaatattttaaattaaaaaattaagggaaaaactcatgatctacaaaatattacaatttcttttcagctctcgcaacttccacctccttggttcaagtgattctcctgcttcagcctctcgagtagctagaattacaggcatgcgccaccattcccgactaattttgtatttttagtagagacggggtttctccatgttggtcaggctggtctcgaactcccaacctcaggtgatccgcctgcctcggcctcccaaagtgctgggattacaagtatgagccaccactcccagccaaaatattacagtttaaataaagacaggattagtagttcacataccaccatttagagaagagaggtttttcatgaaactgtaaaaggccagaattattttcccgagggtatgggtggtagtgccctcttagacaggattttaaagtttaatgatgcatttattcacccccaatatatatattatatatcatatatattttaatatagatttgtaatgtatattaaaatatacattacaaaaatacaatatatttatatattatataaattatatattatgtattatatattttatattatatataatgtatttatataattatatattctgtatttttatatattatatatctttggcgaatggatgtatttattaggaaataaatattttgagaaagggtctcactctgtcgcccaggctgtagtgcagtggcaggatctcagctcactgcaacctctgcctcccaggctcaagtgattctcctacctcagcctcccgagtagctgtgactactggcatgtgccaacacgcccagctatttggatatttcttgtagagacagggttttgccatgttccccagggtggcattcacccaatatttattgctcacttactacatgccagctactttcctaggtgctgcagtcacagtggcccaaaccatggcaagtccaggtgctacttccctacagttatctgggaaagtctttacccacttgattccaccctgcttcaggtccaagatgaacttctcttagaacctgggcttctgacagagacagattttatgaattctgacccctgtgggtttctttaccccattcagtctccagtctatgtattgcacagaatttgactatcttccttctagtctcctttcctttgtctccttatcatcttccaccacctctgacacctgagtcccagtttgtcttccaacatgtgttaacctgagaatccccccaaatcaatcagggtaaagcagaatggaaaagagtctggcctgagattccatagacctgatttcaaccagtcagataggtaacctcaagcaagacacattattctcagtaaagtgagaatctcaggtcaaaccagtggcctccaagtcacggaaatgcattccaggtgtcccctgaggcaaaggggagccaagctggtggggcttcaggctgcccactctacccctactttcagccagaggaccctcaccttcatctcttttgtttactaagttccatttatgattttatatttttaattttttaaaaagaacaatatgtgcaaaagtttgacaaacactgaatcatataatctccaaatttctttgagatttgatattgattagtactgttattatctccctatgtatttattgttgattacatacaaattagagaaagcaatctcacagatttcaaagcgcatttgaagagtcatgtctgatgagggaacaaaacttttcttccaaggggttaaaaagatgccctgtaattccacaaccagtctaccttcttcccttttcctataattaaaaactttttttttttttttgaaatggagtctcgctctgtcacccaggctggagagcaatggcacgatctcagcttctggattcaagcaattcttctgcctcagcttcccaagtagctgggattacaggtgcctgccaccacacccagctaatttttgtatttttagtagagatgggatttcaccatgttggccaggctggtctcgaactcctgacctcacatgatcctcccaccttggcctcccaaagtactgggtttatatgcatgagccaccatgcccagccaataaaaacatacttataatagagacggggttttatcacgttgcccaggctagccttgaactcctggactcaagggatctgcccacctcagccttccaaagtgctgggattacaggcgtgagccaccgtgcccagccaaccactctactttactttttaaatagactattctttagagcagttttaggttaacagcaaagctgagtggaaagtataaagagttcctatatacccgctccccccacacactcacagcctccactgtcatcgacatcctgcaccagagtggttcatttgattttgatgagctgacattgacgcatcattagtacctgaagtccatagttcacactggtcttcactcttggtgttatacactatgggtttgacaatatatgatgacacgtattcaccattatggtaccatagacaaagtttcactgccataaaaatcccttgtgctctggcatgtcctccctctcaccaaacccctggatatcattatcttttgtttgtttgggagttttttgtttgttttgttttatttcatgttttagattcatagtctcactctgttgcccaggcagtggcacaatcatagttcactgtagcctcaaactcctgggctcaagcattctcctacctccttctcctgggtaactgagactacaggtgtgcaccgtcattcgtgggtaactttaaaatatttattattattttttgagacagggtcttactatttcacccaggctgaagtgcggtggtgtgatcatgcctcactgcagccccaacatctcaggctctgatgatcctcccacctcagcttcctgagtagctggaagtcaggagtttgagacccacctggccaatatggtgaaaccccctgtctctactaaaatttaaaaaattagctgtgcatggtggcacatgcctgtaatcccagctactcgggaggctgaggcaggagaatcacttgaacccaagaggcggaggttgcagtgagctgagatcacgccactacactccagcctggggaacacattgagactctgtctcaaaaaaaaaaaaaaaaaaaaaaaaactaccagactgttttcctcattggctttctttacatgcccactagaaatgtgtgggtggtatagtttctctggttttacatcataatttggtgttgttccttatttattatttttgttttaatcattctaatatggttatagtattatctatatgtgtatagtattaaaccattgtggttttaatgtgcatttccctaatgactaatgatgctgaatattttctcatgggcttatgtactatctgtatatcctctgataaaaatttgatatcttttccccattttctaattggactgtttgttttttttaatgttgaattttgagagttccttatatattctacatactagtcctttgtggaatataaagtttgcaaatatttgctccagtttttagcttgtttttattcttttccccgggtcattcatagagtgaaagtttttaattttgaaggagtctagtttatcaatatttccctttactagttatacttttggtgttgagtttaataactcttttcctagtcctagttcccaaagattatcccccatgtttctttcctaaaagttttatagttttctgttttttaaagtaagtcagtgatctattttgagttcatttttttaaataaggtgtgagcctaggccaggtgcagtggctgacgcctgcaatcccagcactttgggaggctgagatgggcagatcacctgaggtcaggagttcgagaccagcctggcccacatggcaaaaccccatctctactaaaaatacaaaaattggccaggtgtggtggcgcatgcttgtagtctcagctactcagaaggcttaggtgggaggattgcttgagcctgagagattgacgtttatgtgagccaagattgtgccactgcactccagcctgggtgacagagcaagaccctgtctcaaacaaaaaaaaaaaaaaaagaaagaaataaaaagaaaaaaacccctttgtcttttctagaaagtgtatgcatacagtgctagttcctttacttacctgtatcccacacgttttgatatgatttctatttctattttatttctggagtctcactctgttgcccagcctggagtacagcggcataatcatagctcattgctactttgaaatcctaggctcaagcaaacctcttgtctcaacctcccaaagtgctggaattatagacatgagccactgtgccctgccaattcaatgtaatttttatttcccttaagactaccattttgaccctctttgacctcttagattctaacaacacagttctaagtggagattttcctgttacctttctgttattgatttctagtttgattccactgtggtcagaaaacacattatattatttcaattcttttaaagttgttgaagtttcttttatggcccaggatgttgtcctgatcttggtatacgttctgtggtatcttgatgagaatgtgtattctgctgttgttgaatggagtgttctattaattttgattaaatcttgttagttgatagtgttactgatgtcttctgtatacttaccaattctctgtttaattgttctttaaatttttgagagaggggtgtggaggtctcaaactacaaatttggttttgtttattactttcggttctaccagttcttactatacatattttgcagctcttataattggttgaaacacttttagaattgctatgtcttcttgttccctttaatatcctttttgtcattatgccactctgtggtaattttctctgctcttcagtctatcttatattaatatagctatttctggttcactttgattaatgtttttgtaatgtatctttcttcattgttttactttcaaaatgcctatgtcgttatatttgtagggagcttttgttgacagcatgtagttaggtcatgcttttttgttcactctgccaatgtcttttaattggtgtatttagaccatttacatttaacgtgattattaatatgtcagggcttatgtatgccattttatttttcgctttatgttctctgtgtttttgtttctattttattttcctgctttcctgtggtttacttgagcagtttttgaaattctgttctggtttatctatagtgtttttgagtatatcttctttttagcttttttagtgattgctgtaggtattctattatgtatacataacttttttacaatctatcgcgtcattttactagtttgagtgaaatatggaaaacttacctccctttctatccctttactctcccacatttataatatagtggccttagatacttcctttacaaaattttaatcccatcagacagcttaaactgtcaaacataacttagaaaatgcaagagaagaaaaatctactgtgttttcccatatttttgcttaccatgttctttcttctttatcttccacaatctctccctactttttataaatcatttccttactgtttacagaacttcctttagccattcttgtaggataggcgtactgatgacaaattttgttttccttcaactgatgatgtcttgattttcccattattcttgaagtattaatttgctgggatgggattctgggttttcaactcttttctttcagcacatgaaaaacaatgtgccacttacttctgttttccatggtttctgataagaaatccactgtcatttgagttgttttcccctgtagatattacaccatttttctgtagctacttaaacaaaaaaaattttttttttttttttttttttgcgacagggtgtttctctgtttcacaggctggtgtgcagtggtacgatcacagttcattgcagcctcagcctcccaggctcaagcagtcctcccaactcagcctcctgcgtagctgggactacaagtgtgaaccaccatgcctagctaatttaaaaaaaaaaaatttagaaacgggttctccctatgttgcccaggctgttctcaaactcctgggctcaagtgatcttcccaccttggcaacattttttgtttgtttgttttcagaatttaattgtgctttgtcttagcatggatttctctgagttcaccctatttggtgttatttcaccttcttcaatctgtagatttatgtcttttgccaaatttgacggctttcaatcactatttcttcaaacttaccccttcttctctctttctaggactccagtgacacaacgttagatcttttgttatagtcccacaaggccttgaggctttatttttcttctaatcactattttctatgttgtttagattgggtagtttctattatcctctttcagttcactgatttttttctcttctcctccattctgcagttcagcccaaccactgagcttttttcttcagctattatagttttagttctaaaattttcatttggttcttctttttcatcttctttttctttgttgaagtttttttattctttgctgaggatttctatttctttcatttgttccaagcacattcctaactccgttttcatggacgccttaaaatttttatgatattaacttaacatctctgtctttttgatattgtcacctatagtttgtctcttttcattccattttgaattttcctatttcttggtgtgactcgtgatttttggtttaagtctggacatttattcattgggagactctgaatcttatttaaatttactttcaacaggcttcttatgactctactccagcaggagatggggagggggtgtgccacctcgttacttctatagcagttcaggttccctacttggcccccagggtggacttaccatgactactgggcaagggtgggagttccaactccccatatggacaccactagcacagggaagaggagggaagggcttcattaccagctatcaggagtgaaagtcaaagtccaagctccttccttggcattctctgatactacacacttggggtataggaggcctcgttatagcctcatgaggatgttaatctcaactccaactcagcctttgctgtcatgagtgagggtggggccacagctttttttttttttttcttttctgtgatgtttggctgaagtttgtgtttgtgtaaaagttttctgcttttcttggctgcccctgtcctggccctttatttatttattttatttatttatttatttattttttcctgatcatattttttgttgggatttttttggtataggtggttccagcttcttcacctccaggttgtggaatatatgaggcaaaaattaaccaaacaaacataaaacccagggaaataaccagcatgttgttcctcagttcctgaagttcctagctttctttccacctttcaagtcttctgctgtttgttttatatgtaatgttcaaaatctttagttgtactgatcaggaggaacagagaaaaacacgtctactccaactttctggaagcagtaagaagtgaattatcgaagcaatcaattaaatatttgtttccttttttatctctacatgttttgaattttctaaaatagaccaattaatttggcagtaagcaaatatacctagttttaaaattatttaaattcaaaattgtatatgctacgttatatccttcctggctatcatcaacacttttcataaggttagtgaagtctcaaggaggtgaccccagcgcattacactgacatagtgttgtaagttgtgttctttgtgaagcggattttgagacagagttttgtgggaaggatgtttgttaaggagtgctcttaggaccagcacctgtggaagggaaaagggtggaagtaggagtacacagggaaggaaggtgaattttgatgcaggctcctcaggaagctctggaactagaatagcccttcagacttggtctgtattgggctgacagccagactttcatactctgcatcactcagttcttgatgtgggctctggaaagagcatcacattgggtgaaagaaatctctgcaactggcacaatttccaaactcactgccagctgaaacttgtctgccggcagcattctcagcaactgaggacacaagtccttcattgaaggagggtcttgatagtgcatcaccacgtataccccacatggatatttctttttttttttttttctttgagacagagtaccgctctgccacccaggctggagtgcaatggccgatcttggtcactgcaacctccacctcccaggttcaagagattctactgcctcagcctcctgagtagctgggattacaggcatgcaccacctgcctggctaatttttgtatttttagtagagacagtgtttcaccatgttggccaggctggtctcgaactccttacctcaggtgatccgccagcctcagcctccgaaagtgctgggattacagccatgagccacagcacccagccatcacatggacatttctaatgggaacatgtctttcaaaacatctcctgtaatctcattttatagatcctgcagcaaaagacaggaattacataaggacacatattaacaactaccttcccaaatatttttttctcacagcaactacagtgacctttacaaaatacaaatctgatcaagtcactcctcaacttaaaatgtttcagtggcttctcattactaaggacagaagtcaaagtagcatatgcgaacctcaaagccttgcacagtctgtcccctgctgctccctctagcatctcgccttccgttcttgccctgccagccatgatggcatttgacattttgaggcaccttgcttcttctcaccatagaccagtttcctctgcttcaaagactccaccctaacatgacaactgcatgagtgatcttatactgcttttggcaaaatatcgctttgtcatctttgttcttatgtgtgtaatgccagactttaagtttggaacattggttagtaatcgaccatccactgtctcattgcacttgcagcagcagaattgttaccatggtgacaaatattgccgttaaaaatattggcttttatctgataggggtattgacttgatgccccaattgataactccctctgaggaagaggcctgttgctttgaaatacataggtatttatgcatctatctcttgatgaagtatcaagatagaaaaggaaatgcagagaaagtgcatggcacagcacgctgtggtgggcaagtccccatctctactttacttaaattgcatttgggtggataaactatattcatgctgaagaagccctcagacaggggagggtgtataaaacaagactagaagaaagacaaaagataaagccatagtctacacaattatgagattaaaccgtttgtagctaggataattcagactctggcatagctgtaaacctggaactccagaccaaaggctttgaaaggagtttccttttatctctctcctctaccccacctgccaacctttcacattcccgggtggctttcccaaaggccctctcagactttagagtatgtgcctctctctctttctctctccttctacctgtacccactgtttcaagagtcaactcccagaacatcttaatctcagcctctatggtatttatcaaaaatcacaagatgagattttccagccacccactagagcaactgagaagggattcccctgatactgacaagccaccgctcctcccagaatacgtcgcttctcacctcctccatcttggctacacatatttggtgttcagaaaaggtccctaagttttgccggaaacccaacttctgtcctccaaggtactgctgctgcagagaatgagcaaagacttgcaaggctgggcaggtgctcccctcctggacttacatggctcccagaatcatttttctcaaatccaaattttattatttggtgttaataatttaatgttttccatggactcattttacaggttttttaaaaacggaaagacaatttttttttacagtaaaggtttttaaaatttataatcccatttctaatgtagtgtgatttttttattctgggaattaacttgcacacgaacacataatttacatcatgttagtacacagcattttggactattttacttcttaatatatttaaacatttttccgtgtttctgaatactttttatgtcacttagaatttttatttcatgcttattgaaagatctttcagacttagatattctgtcataaatctgtcatgtgtatgtgtaaaaaggaaaacattggtgaaataaattgattagggcatttctaaggcagtgatagtgacatgcaattgacaccttgctgacagatttaaaaacaatcctgatttcagagatattaaaataaagatacagtaacaacaccccatgaatacaacctcttctttaagaaatagaataatcactattctgttgaaactccttgtgtgtgcccctcagatcagacatctctccctttatcctatagatagtcactatccttaattttgtgattatcatttccttgtttttctctatacttttagcaaatatatatcccattgttgaatcttatttttgagctgttctacaaattgaactatatcatatatatttttgtgacttgcttttagtatcccacattatgtaagatttatccatgccagccacacatggtggctcatgcctgtgatcccagcactttgggaggccgaggaggacggattgcttgaggtcaagaattcgagaccagcctggccaacatggcaaaaccttgtctctagtaaaaatacaaaaatttagctgggcatggtggtgcatgcctgtaatcccagctactccggaggttgaggcatgagaattactggagcctgggcagccaaggttgcagtgagccaagattatcccactgcactccagcctgggcaacaaactgagactctgtct

SEQ ID NO: 289 - DNA, 23261 bp, Homo sapiens
  2nd Enhancer of HAVCR2
ttattagccttttaccccgggttcagatagttaagcttatcatagtcttcaatacatggacgtactcatcgtcagtcccttgaggtcctttgcttgtttttgtttttgtttttttttttcactttactatttcccccgcattgtctctgacccacattctcatttttctcttctcaaaggcatccaccttacaggggaatgttgagcagctttcaaaagctcacattctcaccgacagtgagaactcttttgatgttctatgctgctgccaatatcagtaccatcaggctatttcattttttccaaaacaatggatatgtaatgatgtcacaatatggctttaaggtcaaactactgtttaatggaaatataacagaatataggacgttatataaacataaatttatagtttataaatactttgaagcaaaaactcaagtaactaggactccaaaaaaaaaaaaaaaaacactgctagtctccataagtctcttctattccccatgccaagaccatgtacttcttcctgatcacaaaatcttcccagcttggcacagtggctcatgcctgggaggctgaggtaggaggattgcttgaagccaggagttcaaggccagcctaggcaacagggcaagactgtctctccaaaacaaagtagctgggtgcaatggctcacacctgtaatctcagcactttgggaagccaagtgggaggactgcttgaggccaggagttcaagacctggacaacagagtgagatctcatctctacaaaaaaaaaaaaattatttataaaaatcttccctctctcctacaggaaatcaccctgaattttgcaattatagtcttttttatagctttaccagctatgtgtgtatcccaaaattatatgtatagttttccttgggtttgaacattatgtgaataaaatcatatagtctgtagtcttttgtgttttatttaagtcaatagcatatttgtgaaatccattcatgctgtttgtatccctgtaggttgtttatgtatttttactaaacagtttttctgggaatgaatatacctcatattctttgttcattctaatttatttatttatttatttagagacagaatcttgcgctctgtctcccaggctgcagtgcagtggctaagtctcacctcagtactacctctacctcccaggttcaagcgattctcctgccttagcctcccgagtagctgggattacaggtgtgtgctaccacgacaagctaatttttgtatttttggtagagatagggtttcaccatgttggccagttggtatcaaactcttgacctcaggtgatctgcccacctcggccttccaaagtgctgggattacaggcatgagccaccacacccggccacgttcattctactttatcttttgtttagttatcataaacaatgccattctgcacattctcatagatgaatcctggtacacaaatagagaagcttctctggactacatttctagagcagaattactgtgtcagaaggtataaacatcttgaaccttactagagaatgcctaattagtttctaagactcccagcagcagtatacagcaatttctttatcctacattctcagcaacgcttggtattatcaaagttggcttttttgtctttttgtttgtttgttgccaaattggtaaaggtataataacatctcactgtggttttaatttgaatcttcatagttattaataagttaagaatcttttgtttcttatttttatttttttaacttttttcattttttgttttttgaaacagagtcttactcttctgtctaggctggagtgcagtggcactatctcggctcactgcaacctccacctcccagattcaagcaattctcttgcctcagcctcccaagtagctgggattacaggggtgtgccaccacatccagctggtttttatatttttactagagacgtggtttcaccatgctggacaggtaggtctcgaactcctgacctcaggtgatccacccacctcggcctcccaaagtgctgggattacaggtgtgagccactgtgtctggccattttttttttctttttgagacagagtcttgctttgtcacccaggttggagtacagtggtgtaatcttggcttattgcaacctctgcctcctgggttcaagcgattctcctgcctcagcctcccaagtagctgagactataggcacccaccactacacctggccaatttttgtatttttagtagagacagggtttcgccatgttggctagcctggtctcgaacttctgacctcaggtgatccactcaccttggcctcccaaagtgctgggattacaggcatgagccaccgtgcccagtcaggatcctttattttgattaggaactatttggacttttttggacaaatgcttattcaactcttttgcccattttcccatcgagtttctatatttttcttattatgcaaataatttatatattctggtactagttatcttctgtttaaatccattgcaaatattttctcccacactgggcttttcactttacactgtgttttcttttttttctttctttttttttcctttttacactatccacgtggaaatatacggtatgttttcttgaacttccttaattttaatatagtaaagttgactaatctttccttttctgagtagtacattagtattagtactttttaagaaattctcctcttatccagagattataaaaatatttgactacattaacttaaatctttataattttgccttccatgcttaagcctttaatcttcctggaatttatttgtgcgtgttttatcccagccccatttattggaaatttcatcattttcccactactttgtaatgacatctctatcctatttcagaaatcacatagtgcaagatgactgactagagatgcctggcactcctctcccccaaaagaaaggaccaaggcaataaataatagctgagatttgaccagatgtcaaagggacagcactagagtacagtgggaaagtagagaggcacctgtgatgactagaaacccaggaggacactatgggtgcacccagcttctgcagcccccatctccccagcccagactggccaagaaacagaagagactttcccttgcaaggcaacagtaagtagaagaaccccagcagcccccactgccaccaaaaatacctacagtccttactacaggagaatcctacaaggtcctcacaagccctgagcccagttaggagaggtgtagggaattaatgcagctgtgtgctctggattgggatacaaggtatgcactccccacccctactcggtcccccaacctggtgtgagccaaactggtgcagcatagtgccatcttgagaccagagccacatctggagtgcatcctcctctgcgggccagtagccactacatctctccagctagggctccatcttcattctgccaagcccacacaggtgactaaatgtcacaaccccaactctgcagaggctgggcccaggattagctctgactctggccttgcccagcagggaaaccaacccctgctgctcacatattcagctagaaaaatagtctggcagtcctgcccccggcaaacccaccctaaagccagccaaactactgtaggccctcccctgagcaagagaggtccctgagccatccaacagctgacacatttgtaagctagcagggtggctacatgcctgcatccaaagcctgaaaaacagccctgtggcatctagcaccccctcctacaattgcagacatacctctagcctgcccaaaggccctgcaccccaaatcaggacctcagaaatagccctgttgactgcccatggcaggcgcatacccaggcagaacaagcagctgtgtgaccatgtctcaggcttagaaaacagcccaatgagccattcctggcagtcaagcccccaggccaactgagcagcttgggccagggaaacagccccacaggccactcctgtctggcatgctcccaggctgatcaagctgctatgtgcccatgtccagggcctaagaaatagccttgcaggctgctcctggcagacacacctccaggccggccaagcaactgtgtgtcccctcacatcctaggcctgagaaacagccccatggtccacccccaccagacacacacccaggccagctgagcagctatgcaccccatcctgggcctgagaaatagccctgtggtccacctttaccataccatatggccagccaaaaagccatatggccacatcccaggcctaagaaacagccctgtggaccaccctaaggagacaccccccaggccagcccaaataacctttactcactactcagaactaaaaaacagccccaaggaccatccccaggagacacacacccccaggccagcaaagcaaccagtgtactggactcaagaaacagcacaatgggccacccctggatgatcggccttcaggctagccatgaaacagcacactgacgcccttagttaaagtaaaagctctgtggtcccaaccctgatgagtgagaccccaagttggccaacccaccatgggcatgtaggcacactgacctgagaaataacctgaaataacctgaaagcccacttccagcagagctgcaccaccactgccacaaactctcttagcctatgccactgagacacatgcaaacatcactaacatggattacagctgaagaaactacatggacactgcactactgcatccacctagaaccaaagccagtgcaccccattgaaccaacactccaagaccatctatgcaaataagtcattgcctactaaacctactgcatagaattggaagaggcaaatgtttcactgacttgcatagaaatcattgtaaggaaaagcaagaaaacatgtctcttcccaaagaacacaatagttctccaataacagaccccaatactaaggaaatattaaaaaggccagaaaaagaattcaaaataataattctaatagaactcagtgagatacaagagaatacagatatacaattcaatgaaatcaggaaaacagttcataatttgaatgagaaattcaacagatatatatcatttaaaaaagaaccaaatagaaattctaaagctaaagaattcaatgaataaaataaaaaatacaattgagagttctgacaatagaatggactgagccaaaggaaaaaaaaaaaaatccctgaacttgaagacaggtcttttgaaataatataggcagacagaaaaaaaaaaaagaagaagaaagaaagaatagaaagtttacagggtttatgagccatcactaagcaaacaaatatttgcattacaagcattccagaagcagaagaaaagggaaaagttatattaaaaaaacatatttaatgaaacattccaagtcttgggagaaagatggacatccagatctaggaagctcaaagaaccccaaatacattagattcaaacaggtcctctccaaggcacattatgtcaaattatcaaaagtcaaagataaatacagaattctaaaaacagcaagagagaagtgttgggtcatatgtaagggaatctctataagactaacagtgaatttctcagcagaaactttatgggccaggagagaatgatttaaggatttgaaagaaaaaaaaaaaaagcctgccagccaaaaacttcatacccagcaaagctatcattcagaaatgaaaaagaaatacaatctttcacagacaagcaaaaattgagggaactcatcaccactagatgagccttataagaaatgttcatgggagtcttacatctggaagtgaaagacaagaaccaccatcatggaaagatacaaaaatataaaactcattggtagagccaatacccaaagaagaaatagaaaggaataataccttatcactagagaaaaccactcaactgcaaaaatagtaagagagaaattaaggaacaaaagatacacaaaacaaaaaaagtcaataaaatggcaggaataagttctcatctatcaataataatcttgaatgtaaactaattaaattccatatttaaaagataaagactggctgaatggataataaaacaaggcccaactataggctgcctacaagaaactcatcttatatgtaaagacatagattggaaatgaaaggattgaaaaagatattgttttgcttttggacaaagatttttgctcatggaaaaagatattctttttcttttttactcctgcttgcttttgaaaagcaaaaatataaaactcattggtagagccaatacccaaagaagaaatagaaaggaataatatcttatcactagagaaaaccactcaactgcaaaaatagtaagagagaagttaaggatttctgatttggaaagccaaagcaagagagagtagctatacttatatcagacaaaacagacttgaagtcaaagctgtataaagagacaaagaaggacattatataataataaatggatcaattcatcaagaaaatcaaacaattgtaaatatatatgcacccaacaccatgcacccagatatacaaaggaaatattgtcagatctaaagggaaagatcgatcccaatacaaagcagttggggacttcgacactatactctcagcattggacagatttctagaaagaaaatcaacaaaggaacactggatataaattgcaccataaaccaaatggacctaacagacatttacagaacatttcactagatagctgcagaatacacattcttctcatcagcacatggaacattctccaggactgtcagccaggctggagtgcaatggcaagattcagtttactgcaacctctgactcccaggtccaagcaattcttctgcctcagcctcccaagtagctgggattacaggcacctgccaccacacccagctactttttttattattattatttttagtagagatgggttttcgccatgttagccaggctggtctcgaactcctgacctaaggttatctacctgcctcgggctcccaaagtgctgggattacaggcatgagccaccacacctggctaaaaaaaaatttcaaaatcaaaatcatatcaagtatcttacctgaccacatggaataaaactagaaatcaataaaaagaggaatattcaaaatgatacaaatagagggaaactaaaagacacgctcctgaatgactaatgcatgaagaagaaattaagaataaaatttttaaaatttatttatttatttatttatttatgaccaagtctccatctgtcttccaggcaggagtgcagtggtgtgatcatggctcactgcagcctttacctcccaggctcaggggatcctcctgcctcagcccactgagtacctggaaatacaggtgtgcaccaccacgcttggctattttttgtagagacagggtcttgctatgttaccttggctggtctcaaactcctgggctcaagcatctcttgcctcatcctccccaagtgctgggattacagcatgagccaccgcacctggccaagaatgaaattgcaaaacaaatgaaacaaattaaagagcaagtaaaacaaattaagagagaaattaaggaacaaaagatatatataaaagatatatcactcttggccgggcacggtagctcatgcctgtaatcccagcactttgggaggctgaggcaggcagatcacctaaggtcaggagtttgagaccagcctgaccaacatggtgaaactccatctctactagaaatacaaaaaatttagccaggcatggtagtgcatgcctgtaatcccagctacttggggggctgaggcaggagaatcgcttgaaccctggaggcagaggttgaggtgagttgagatcatgccactgcattccagcctgggcaacagagcgagactctgtctcaaaaaaaaatatatatatatatatgtatatatatatctctctttgtttccttgaaacaaatgaaaatagaaacacaacacatcaaaacctgtggaacacaggtaaagcagtattaagagacaagttttttgttgttgttttttgggggcttttttgaaacagagtctccattctgtcaccaaggctgaagtgcagtggtgtgatctcggctcactgcaacctccattaagaggcaagtttatagcaataaatgcctacattgaaaaactagaaagagggccaggcatggtggcacatatctgtaatcctagcacgctgggaggccgaggtgggagaattgcttgaggccaggagttcaagaccagcttgggcaacatagtgagaccctatctctacaaaaataaaaaactttattagctgggcatggtggtgcatacctgtagtactgctagtcaggaggctgaggtggaaggatcccttgagcccaggaatttaaggttgcaatgagccatgattgtgccaacaatgcagccatgattgactccaacctgacagagtaagaacctgcctcaaaaaaaacagcaataataaaaattaaaaaaaattaaactagaaagatttcaaatatgctatcctacaaaataaattctagagagaaaagaaaaaaagaaggatttcaataaacaacttcatgacatatctcaaagaactactaaaggaagaacaaaccaaatccaaaattagaaggaaagacataataaataccagagcaaaaataaaaatacaaaagattaataaaacaaaaggtgattttttgaaaagataaacaaacttaatgaaccattagctagaccgactaagaaaaaaagagagaagacccaaataaaatcagaaataaaaaacgagatgtcacaatgaataccacagaaatacaaaggatcattagagccaggtgtggtggctcacactggtaatcccaacactttgggaggctgaggtaagacaatcgcttgtagctaggagtttgagaacagcctccagcctgggcaacagagtgagactctatctctacaaaaaaattagtaaataaaaaaaatattttgttgttgttgttttgagatggagtctcactttgtttccctggctggcatgcagtggcacgatctcggttcactgcaacctccccctcccaggttcaagtgattctcctgtctcagcctcccaagtagttgggatttcaggtgcctgccaccatgcctggctaatttttgtatttttcatagagatggggtttcaccatattggccaggctggtcttgaactcctgacctcaagtgatccacccacctcagccttccaaagtgctgagattacaggcatgtgccactgcacccggccaaaattttttaaaaggatcattagagactattattaacaactatatgctcctgaaagcaaaggcaagcaggagtagctatccttataccagacaaaacagacttcaagtcaaaagctgtataaagagacaaaaacctagaggaaatggataaatttctggacatatacaacctatcaatattgaaccaagaagaaacagaaaacccaaacagaccattaacagattgaatcagtaagaaaaattatcccaacagactgggcatggtggctcacatctgtaattctatcactttgggagatcaagatgggaacattgcttgaagccaaaagttcaagagcagcctgggccaactaagcaaaagcccatttctttaaaaaaaacagaagaaagggaaaaagaaagacagaggaaggggggaggggaggggaggggaggggaggggaaggggaggggaaggcgaaggaagggaattctcccaacaaagaaaagtccaggatcagagggctttaccactgaattctacagaaacctttaaatgataattcaaaccaattcttctcaaactattcctaaaaattaaagcagagggaattcttcctaactcattatatgaggctagcataactaataacaaaactagacaaggacacaacaaaaaaagaaaaccacaggccaatattcctgatgaacacagatctaaaatcctcaataaaatactagcacagtgaatccaaaatacatcaaaaagataatacaccatgatcaagtgggatttaccccagggatgcaaggctggttcaacatacataaatcaataaatgtaatatattacattaaaagaatgaaggacaaaaaccacacgatcatctaatagaagcagaaaaagcatctggtaaaattcaacacaccctcataacaaaaactctaaataattaggtatagtagaaaagtaccaggctgggcatggtggctcatgcctgtaatctcagcactttgggagggtggatcgtgtgagtccaggagtttgagaccagcctggacaacatggtgaaaccccgtctgtacaaaaagtgttctaaaagttaggtgagcacgatggcccatgcctgtagtcccactactcaggaggctgaggtggtaggattacctgagcgtaggagtaggaggttgtagtgagccaagattgtgcccttgcactccagcctggccaacagagcaagaccttgtctcaaaagaaaaataaataaaagtacttcaacacaataaaggctatacatgacaaacccacagctaagatcatactgaatggggaaaagctgaaagtttttcctctaataattggaaaaaaacaaggatgcccttttactcaacatagtgctaaacacattcagtaaagttgcaggacacaaatcaacatacaaaaatcggtcacatttttatataaaaacaacaaactcatcaaaaaaaaattttaaagtcaatcccacttacagtagttacaaaaacatacctaggaataaatttaaccaaggatatgaaagacctctacaaggaaaactacaaaacattgatgaaaaaaagtgaaaaggataaaataaatgtaaaggcatcccatgctaatggatcagaagaatttatattgttaaaatgatcatactacccaaagcaacctacagatttaatgcaatgcctaccaaaataccaatgacattcttcagagaaattgtttttttttttttttttttttttcttgagacggagtctcgctctgtcgcccaggctggagtgcagtgacacgatcttggcccactgcaacctctgcctcccaggttcaggccattctcctgcctcagcctcccaagcagctgggactacaggtgcgcaccaccacacccagctaatttttttgcattttcagtggagacggggtttcaccatgtcagccaggatggtgtcaatctcctgaccttgtgatccacctgcctcggcctcccaaagtgctgggattaccggcatgagccaccacgcctggctgagaaattgtttaaaaatcttaaaatttgcatagaaccacaaaagaccctctgaacaaaaagaacaaagctgggggtatcacactaccagacttcaaaacatattacaaagcggttgtaaccaaaacagcatgatactgtgtgtcaaaaacagacacatagaccagtggaagataatggagaacccagaaataaatccatgtatccacagccaactgatttttgacaatactcattggggaaaggatagtctcttcaataaatggtgctgggaaaactggatatccatatgtagaagaatgaaactagaccctcacctataaccctatacaaaaataaactcaaaatagatcaaagacctagatataagaccccaaactataaaactactagaagaaaacataagggaattgcttcaaggcgttggtctgagaaaatattttatgaataaaacctcaaccacacaggcaacaaaagcaaaaataaacaaatgggattatatcaaactaaaaaactgtacatcagggccaggcatggtggctcatgcctgtaatcccagcaatttgggaggccagggggcgtggatcacctgaggtcaggagttcgagacaagcctggccaatatggcaaaaccctgtctctactaaaaacacaaaaattagccagacatcatggcatgagcctgtaatcccagctactcaggaggctgaggtgggagaatcacttgaacctgggaggcggaggttgcagtgaaccaagatcgtgccactgcactccagcctgggtgacagagtgagactctgtctcaaaaaacaaacaaacaaacaaaaactgcgcatcaaaggaaacaatcaaaagaatgaaaagacaacctacagaatgggagaaagtgtttgcaagctattcattcatctagtggaggataaatgtccagaatacacaaggaactcaaacatctcaatagcaaaaaataaacaatctgattttacaatgaacaaatgatctgtacaaacatttctcaaaagaaaatacataaagatggccaacaagtatatgaaaaaaatgctcaacaacactaattatcagagaaatgcagtccaggctcagtggctcatgcctataatcccagcactttgggaggccagtgcaggtggatcacttgaggtcaggaatttgagaccagcctgaccaatatggtgaaatcccatctctactaaaaatacaaaattaatcaggtgtggtggcacacatctataatcccagaggcagaggttgcagttagctgaggtcacaccattgcactccagcctaggcaacaagagggaaactccatctcaaaaaaaaaaaaaagaaaaagaaatgcaaagcaaaactataatgagatatcatctcacctcaagacagcaattacgaaaaaaagaaaacataaatgctggtgaggaagtagaggaaaaaaacttttttttttgagacggagtttcgctcttgttgcccaggctggagtgcaatgttgcaatctcggctcacctcaacctccaccttccaggttcaagcgattctcctgcctcagcctcccaaagtgctgagattacagatataagccaccactcctggctgagtatctcatttttaagttattgtttgttgctggtataccagaataaaattgatttttgaatattttttcctcagcaatcagtaaactcattaataagttatctgtgggttacactgaattttctatgttaacaaccattttctgcaaataacgacagttttgttccttccttttcaatactacttttttttttccttaccatgctggttaggaaatctagtacgtatttaatagacattttgatagcaggcatccttgttttactccagctctcaaaggaaatttacaggttttcatcttgagtataatacatgctataggttttatggagctactatttattatattaaggaagtcttcttctattcctaatgttctaaaggttttttctttttcatggatagacgctaatttatttatttatttatttattttttgagacagagtgtcactctgtcacccaggctggagtacagtggcacgatcttggctcactgcaacctccgctacctgggttcatccaattctcctgcctcagcctctcaagtaggtgggattgattacaggtgtgggctaccacgcccagctaattttttttgtatttttagtagagacacggttttgccatgttggccaggctggtcttggtctcctgacctcaagcgatccacctgcctcagcctctcaaaatgctgggattacaggcatgagccaccacgcctggccaatgctaaattttataactgccttttgcatatcttttgagatgaccaagtgatttttcttcaatttatattgttgtgacatattatctattctatattcctgagataaacacagattaaccataatacattaccttttatttttacatattattgggtccaatttgctagtattttgtgctagcctcataaaaacagttgggacatacttcctgtttttctattctctgaaagagtctgtataagactgaaatcattatttatttatttattcatttatttttgtatttttttctggcaatgtttggcagacttgccagcaaagctattttttgtttgtttggttttgtgtttttgtttgcttatttgcttttgctaatcagctgactttaagattcaccagtatagctatttgaacttttaagttttctttgtgagaagattttgactattgatccatttattttaattgttagagaattatcctggtttcctattcctcaatctgtattggtaattttctaagaatgtgtccattttgtctaaattttctaacttattaaaaaatccatattttacttttttactataataatgtcccccctttcatttctgctattatttgtgccttcctctttttttttttttttttttcgttatcagtctcccctgcaagtagcagtgactcagagccccagaatcaagcaccacttaagcctccagggcactcctgctgccctttcagatcagatgcttctgcacagatgtttagcgggccctgagtatgtcgcttcgaggcaaatgagtttcagaaagaattaggatgggtctccacggcacgtgttacctatgcaacaaacctgcacgttctgcacatataccccagaacttaatataataagtataataaaaaaaaactaaaagaattaggatgggtcttctctttcattctcagcgttagatggtacctacgctatgcggagatgtgtattatgtttaccattgttaaggaaattgagttttatggaagttttttcttttttgagacgtagtttttctcctgttgtccaggctggagtacaatggtgcaatctcagctcgctgcaacctctgcctcacgggttcaagcaattctcctgcctcagcctcccgagtagctggaattacaggcatgcgccaccatgcccggttaattttttttttttttttttttagacggagtctcgctctgtcgcccaggctggagtgcagtggcacaatctcggctcactgcaagctccgcctcccgggttcacgccattcacctgcctcagcctcccgagtagctgggactacaggcgcctgccatcacgcccagctaattttttgtatttttagtagagacggggtttcaccgtattagccaggatggacccggctaattttgtatttttagtagagacatgatttcaccatgttggtcaggctggtctatgaactcctgaccccaggtgatccgcctgcctcggcctcccaaagtgctgggattacaggcatgagccacgccgcccagcaggaagttaatatacgaaaccgagatatacagctgattaaacagtagagccctaggattctggggtgttttccaacaccaaccatttctctaattcaacagacaaagtacgtatctaatgattcaatttaattctgacactaactacccagagttaagttagggtaagcagtacctctgagtttcttcattttagtctactctgcaaccagctacagctcttaaatctgaggtaagagtgccacttactggtagcctcatcacaacgcaacttgaaacccgctcacaaatttaattctaagtgccagtggcatgcaaaagaaaaaaggctcagtacggtatgcatatattaaaacattacattgtacctcacaaataaataatttgtcaattaaaaataaaataaaacttaagtgctttgtagccattctcctatttaatccttggattaatcctatgaagaagcttctgtaatttatatttctgtgattttttattagtagctttgtgaaaacactccaaagtttagaatccaattacctacatcatagcccaccagccaaatccagcctgctgtctgattttgtactctcacatctaagaataattgtacatgctaaatagttggaaaaaatcagaataattcacatatgaaaattattgaaattcaaaattcaatgtccatatagaaagctgtattggaaccgagctctcttgtttatgcattgtctatggctgctttcgacccacagcagttgagtagctgcaatggaaactgtacagtcctcaatgcctaaaatatttactaattgaatctttacaaaagagtttgccaattcctgacctagattccaacctgagcaaacctaaactctaatcctcaattttcattactcataaaatggggataatacctactaagagtttttaggaagattagaattataagcacagaatctccttaagatactcatagaagtctaagctaagacataagcaccttaatatgttcaaagggaactcatagtttccatctataaatctgttcagcccagtatcaagtagtatttgcaagcatggattttagggtcaaaatattggctccactcttggtttcgctacttacttacctacgtgacttagtaacaacatgagggaatggagaggcaatgaagtatgaaggttgagtgttcaggcttggaaaactagaatgcctagtttccatcctggctttgccacccactagtcagttaaccttgggtaaattacataacttctctgagcctccacttccacatctgaaatatgagtgtaaaaagaatactgatttcattcagtagttgtaaggctaaaatgactttatttatacaaagagattaaaacattgccagcaacttacagccataaataccatcagatttagaaggttcttcacaggattgttctaaggattaaataagagaacagctacaaagcacttagcaccatttgcagtacttagaaatctatcagagtacagctagtacccttcctactgattctctgtattttagtaaaatctgatgagaaatcaattgcaaacataatttctcatcagatttcagataaaaacccaattccttcccttggttctctaaatcatgcacatctgtcctccacctgcttctgaagctccaacctcctccctcaccatattgcagccatagtagcctttctcatccaaattatgccaactttctatctcctcatgagatatttgcacctgccgttcccagtaacctcagggctcagtgcatgagttgaagctgcctttctttatgtttttgagacatggtctcactctgtcactcaagctggagtgcagtggcatgactgtggctcactgcagccttgacctcctggactccagtgtcccttctacttcagcctctggaatggctggaacccgtcatgtgccatcacatccagcgaatttttaaatatttttgtagagatggggtctccctatgttgcccaggctggtctcgaactcgtggactcaagtgatactcctgcctcagtttctcagtgatgggatcacaagtgtgagtcaccgtgcctagcaaagttgccttctaaattccttaacaaatgtgaggttaggcatggtggctcacacctgtaatcccagcacttcgggaggctggaggattacttgagctcaggagtttgaaaccaacctgggcaacatagtgagacctcatctctacttaaaaagaaaaaaaaagttttaggccgggcatggtggctcacgcctgtaatcccagcactttgggaggccaaggcaggtggatcacgaggtcaggagatcgaggccatcctggtcaacatggtgaaacctcttctctactaaaaatacaaaacttagctgggcatggtggtgcacgcctgtagtcccagctactcgggaggctgaggcaggagaatcacttgaaccagggagttgcaggttgcagtgagccaagattgcgccactgcactccagcctggtgacagagtgagactccatctcaaaaaaaaaaaaaaagttttaaaagacaaaaaaaaatgtacacattccttgaaaagggaagataatgtggacaaggtgctttgaacaggcaataggaacataactggaagcaagattcttctgaaggtgctgtaatggctgagtggttaagacacaaacttatcaccttcaaaaattaactcgtcttattatctttcttacattttccttcgcccttcccacacatccaacagttaaactagtatcaggcagagtgcagaccacagtaagtattcatcaaatgaatatcatgaataaatgaatagctggggaaaaactactctcataaagggaatacaaatttgtacaatccgtttatgtttgttatttatattaagttcacatgtgcctgatttgtagtagatctctcgttatcgttagctcagcaccgcttccttcctctgagagacagactgactcttccataaatagacatagcggggactgtgaaattcttatgggatccaagtcccagttgatttgcccagttgcaatcaagtatacaacccctaattcctcatgtctagctcgttaattaacctcccctcattttttttaagtttgcatttgagagggaactcccagacagtggtaaacatagaaatacttaacccttaggaactgtcagctgccatgttctccacctacatcattaaagaagttcatctgtaaagagaatgaagctaacaggaaagatggtctccagggctactaacttaaaacttcatccactttctgaccttctcatggtttatatattcaacttatccttcaatcaacatatcccatatcctttctttttttaattaaattgtaagagagagaaggtctcactatgttgcccccattggtctcaaattcctgagctcaagtgatcctctcacatcaacctcccaaagcactaggattataagtgtgagccaccgtacccagcccataccccatatcctttatataaattcatctttttgcttaaattagttcaagtagggtttttgtcagcagtaacagagcactgattaatgcaacattctgtaaccactgcacaagagaatcatcttctgatttcttaaaaccaatgctagtaccccagtccaaaaaatgaaatcagaatctccgcagtgtgggacctgggcattagtcatttcaaaagctgcttaaaaaggtgatccttccagatatttcacttcaatgaatcaatctttcaagaatattcattataagtaggtgtgcagagatatattttaacacaagattaaaaagaccttatataaggccactagagcttttttttcattccactctaatagcaagagttcatatcagaacactttaggaatttatgtcaggtcctagtcacagacctgcaagatcagatcctccccaatggcatttttttttctaatttgttgtagagacacggtctcactatgttgcctaggctagtctcaaactcctgacctaaaaccatcctcctacctcagcctcccaaagtgctgggattacaggcataagccactgtgcctggccccccagtggcattttaatccctcaacgcccctccccccaacacacacacgttcatatataagtagtgttgtggctcttatgtgattctgttttttacatgcaaagattttcaaagtggccaaaaactggttttgcacctcaacccaacaccttcctcaaggttctcagagtcaaagaaagagaattttctttggagagttgttcaagtgctaagcaatttccacctttctccctcacaaggtgatgctccctacttcaatttaagcttgagagcctgaactatgtcctctggagtctctgaggcccaaaggtctataccaaacacattacgtaccagaaaaaaacaaaagttgagactagccaaccaactgcctatctgataaagaagtgtctacctagggataacttacagtccctggatctgtgaaagcacagcatgcacatttcatagagaactgacctatagtcatacatatatacatacatacacatatatatatatattttagacagagttttgctgtcacccaggctggagtgcagtggcacgatctcggctcactgcaacctccaccccttgggttcaaggaattctcgtgcctcagcctcccgagtagctgggattacaggcgcctgccactatgcccggctaatttttgtatttttagtacagacggggttttgccatgttggccaggctggtatcaaactcctgacctcaagcaatccacccacctcagcctcccaaagtgctaggattacaggcatgagccactgcgccaggccccttataatcattttaatgtgaactttgctagctctaggaccaatgaaagtttaagtgagcaaatccctatgctagaaaccaggggctaaggaagaaataaaaaagtagacatctggggaaaggcattgcctctcaatggttcttttttgtttttgagatggagtttcgctcttgttgcctaggctggagtgcaatggtgcaatctcagctcaccacaacctctgcctcccagattcaagtgattctccctgcctcagcctcccgagtagctgggattacaggcatgcgccaccaagcccagctaattttgtattttagtagagatgggatttccccatgttggtcaggctggtctcgaactcctgacttcaggtgatccaccagcctcagcctcccgaagtgctgggattacaggagtgggccactgcacccagcctcaatgtttcttaatcttgagcatgtatcataatcacataggcttcttaaaatacagcttgctgggacctacacccagaagtttctggttcaaaaggtctgggatggagccagagaaccctcatttattttttatttttctgaacctacggattatactaaaacttttatttctagtaagtccccaagtgataccaatgctgctggtccaggaccacacactttaagaaccacgggcctacattaagaaaacggcaggcagagatcctcagacacaaggtcaactctccactaacaccttggtggaagagcagatggacagtcgggggaagaagagaagaaagtgctcatataaagtccaattagctaggggcagagtggagttactgaaaggaagacttagtcctcacggtcattcaaagaaccagactgacaatctttgccatcttcggtggcttccaaacttatcctggatacgaccgtccaaccagcagctgggagaagagaatggaggatcatgcaagaaatgtttatggggcaagcctggattcctatgcccacatttcaccgcctacgacttagtcatatgttctcacagagatgctgggagtagggaaatgtccctggctggattgccacatcttgacaacatatcttcaaagagcaagaatctttggtagacacctagcagtctctgccatcaaacccctttcccattgtggacttaaacaagtctgagcttagctttaaagaaaatgtatagctaatgacacagacatcttaattactaaaattaatgtctgtaacttaaagtgaccaaaggacttattacctgagtgactggaaaaaaaaacaacaatttatgggacttccctgcaagagtccattcaggatagggagaaaagactgagctagtgggtttacagaagcagtcatgaggaaaaaatgaagtttctattttataactctactgggctcctctctatcaacatgttatgctactttttggagcttaagcaaaatttttaatggaataagtctaaagatttcatagttttacatgtagagagcttaatatccatttatctatcattcttaaagcaaatgctaaatccccttttcaaagacgaaaactttgctattattgaggttatcatcaaagttttactgcaactctaaaacataggaatgtcccatacaacagcagctaacactttgctttttaaagtgattcttcttagtgcagggacactcatttgtctatgcttgttatacagcgaaattactgcctatgacatctcataattgaaaaatttggagtcaagattaaagctgtttacatttttagtgaaacttctcttaagactgtccaaaagaaaatgaactaatatatgatgctattatcaaaaggaaaaaaagaaaaagaaacatctttcatggtctttcattcatctcatcaattaggacacacaaggcagcatctttctctataatctgatctctcctatgacctgaattttctctttgatgttcattctgtccagtacaattgttgctatcatcagcatccattggttcagtttttactctcattcctgcttctgaatgaggcaaatcatcaggcaaagaagccaagcaattctgaatcatttcaattactcgttccaggtgcttttgaaatctctcagctgtttcaagccgttgacgtttctggacctccatcatgactctcaaggtctctcttgcttggtggggtcggtattcatttataagatgatgcacgtgtacaaaaagcagcttaagatcttctagtttctcttctcgttttatactcccagggctccttattaaaatatctaaaaggtccaagaaattaataaggatagacatattaagttttctcagttctttcttgtgatcaaactgcataggatgaagccgttcgatgccctgactttccaaagggcggatgataagatcatcacattggaactgattgccaaacatcatgtaactgtcttttattggagggggaggcttgggagctaagccttcttgaatattttcatccgtatattccttgatatattgcattggaggtggtggaagtgcactcacttgctgtggttcacccattgtggactatcaagaacctatggacacagaccaaagatttattagagccacaagacaaacctgttacatttcataactacagatggaatattttcttccttttcttccagcagtttggggccgaagacaagatgatctccttggtttctaaaactaacatttatgatagggaaagtctgccatcttttctaagtaggcattatattctcaaccattcacatattttccattctctctctaataatttcatcagcattaaaaaatatgtagcatcctctcatctctaaagaaaatcttctggactccatgcccctcaccacttatgccccatttctttactcttccataaccaaactacacaggctgtctcccaatctcatatcacaatcacttttgttttatgttatagatttatttccaatagcaaacacttacttgtatctctcataaacactctgacaaaattaacattgctaaatcctaaacacattatta

SEQ ID NO: 290 - DNA, 15381 bp, Homo sapiens
  3rd Enhancer of HAVCR2
cgcctcgacctcccaaagtgctgagattacaggcatgagccacctcgcccagctgtttttaattctctaagttatcatttgccatctccttggccctttgtagtaattcccctcccttttttgtttttctgtgtccatctttcccattccaaatacttgatgtaaagggagattccaccttgaaaaccagagttccagtcctggcttgctgctacactctactgctgaccttgatcttgaccttgaccttgtctgcatttatttctttgatgaggagggcagacagaaaaacattgctatagtgcttaatttttttttattacaaaagaaaatgaagaaaataattcaaactatagcagaaacatgaaaaagggaaaagtgagtcttcactatttgtctccttcagtaaccatatttatttgggtatattcttgcatgtttttacggcaaaaacaaattcaacagatatatatatatactattatggaaccctttttattttcctttgaacttaactacgtagcattctctgataagtaatgtaagctccagacagcaaggatttttgactgcttcattcactgctatatttctggagactagaatactgtttggcataaagtaggtgccaacaaatattcactgaacgcaccagacgtggtggctcacggctgtaatcctagcactttgggaggccaagacgagcagatcacttgaggccaggagttcaagaccagcctgaccaacatggtgaaaccccgtctctattaaaaatacaaaaattagccaggtatgggggcgcatacctgtaattccagctactccagtgagtatctggacaggggaatcgcttaaacctaggaggcgaaggctgcaatgagccaagattgcaccactgcactccagcctgagcaacagagtgagactctgtctcaaaaaaaaaaaacttaaaaattaaaaaaaaaaaaaaaaacagaaggggaccaaatatacacatccctggctccatggaactcccagttgacctgacggaaaaaaaaaaaaagaagaagtagtatatatacatatatataggtagtatataaatatatatatagtagtatataaatatatagtagtatataaatatatatatagtagtatataaatatatagtagtatataaatatatatattagtagtatataaatatatatatatttttttttttttttcactgaatgaatgaaaggacacaaatcctccttgctgtcagatcaactaggagttgaatggaatggagccgggaatgtgtctatttggtccccttctgtggtcccagcaccaaacaaagtgcctggcacacagtaagcatttaataagtatttgttgatttagcaaaaaagcttaatgataaaaccacctaattctttttacttgcaccagtgtattgacataacactgtaatcaacaattcccttattcattgtaaaaatctccgcaaacaccattgcaatgatcagccttgtacacatacccttatttaaagattttggtaggataagaatgtcttttgagggggaccattgatctgcttcaaatgtgtcgtgaagtttcttctcactaggatttcatggcattaagacacttatgggctgggcacgataacccaacgcctgtaatcccagaactttgggaggccgaggcgagtggatcacctgaggtcaggagttcgagaccagcctggtcaatatggcaaaacctcatctctactaaaaatacaaaaaattagccgagtgtggtgatgtgcacctgtaatcccagctatttgggaggctttggtaggagaatcacttgaactcaggaggtggaggttgcagtgagccaagattgtaccaatgcactccaccctgggcgacagagcaagactctatgtcaaaaaatttaaaaagacagttcagattaattttttagcctgtatgagagctgttccctacaattaattttgcaaaatgatctcccttacgtatctgcctacagaatgtcagtctgtcccgaaactatctagatgcagcccaatgctctaattcacacgagactgtcagaaagacttctagaaacaagcaggctggcgacagccttgctggccaacatcttctgcatgcaacacaatcacagcttagtcatcacctggggaggaccagtttttaggcagtgataggcccatattgttaattcattccgatgtgctgaggatggctcagcagaaagaaggaaatagacaaaagagtaagaccccaacaaaggcctgagctgaacaatgttgagaaacaaaggccactttggcctggataagagttaatatggggctgggcacagtgggtcacacctgtaatcccagcaatgtgggaggtcgaggcggtcagatcacacagtcaggagcttaagaccagcctggccaacatagtgaaaccccgtctctactaaaaatacaaaaattagctgggtgtggtggtgcatgcctgtagtcccagctacttgggaggctgaggcaggagaatcgcttgaacccaggatgcacaggttgtgatgagccgagattgtgccactgcactccagcctgggcaacagagtgagactctgtctcaaaacaaacaaacaaacaaaagagtgaatatgggagcttctgggtatttgtgagttccctaagaagtgaacttgcagagtcacactctctctgagctgtctaatggaagtcttccagaaagctacctttctgattatttaagtttttcactccaaaaatatttagtccgggcacggtggctcacgcctcaaatcccagcactttgggaagtcgaggcaggggggattgcttgagcccaggagattgagaccagcctagccaacatggtgaaaccttgtctctactaaaactatgcaaattagcttggcatggtggtgcatggctatagtcccagctactggggaggctgaggcagaagagtgaattgtgcccaggaggtcaaggctgcagtgagtgaagatcatgccactgcactccagcctgggcgacagagtgagattcttttattattattattattattattattattattattattattattattatactttaagttttagggtacatgtgcacagtgtgcctgttagttacatatgtatacatgtgccatgctggtgtgctgcacccattaactcgtcatttagcattaggtatatctcctaatgctatccctccccccttcccccaccccacaacagtccccagagtatgatgttccccttcctatgtccatgtgttctcattgttcaattcccatctatgagtgagaacatgcggtgtttgggtttttgtccttgcaatagtttactgagaatgatgatttccaatttcatccatgtccctacaaaggacatgaactcatcatttcttatggctgcatagtattccatggtgtatatgtgccacattttcttaatccggtctatcattgtcagacatttgggttggttccaagtctttgctattgtgaatagtgccacaataaacatacgtgtgcatgtgcctttatagcagcatgatttatagtcctttgggtatatacccagtaatgggatggtggggtcaaatggtatttctagttctagatccctgaggaattgccacactgacttccacaaaggttgaactactttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttctaatgtgtcttttggctgcataaatgtcctcttttgagaagtgtctgttcatatcctttgcctactttttgatggggttgtttgtttttttcttgtaaatttgtttgagttcaaacagagccaaatcatgagtgaactcccattcacaattgcttcaaagagaataaaatacctaggaatccaacttacaagggacgtaaaggacctcttcaaggagaactacaaaccactgctcaatgaaataaaagaggatacaaacaaatggaagaacattccatgctcatgggtaggaagaatcaatatggtgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaagtctacagtaatcaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccctaaaaaccctagaagaaaacctagacattaccattcaggacataggcatgggcaaggacttcatgtctaaaacaccaaaagcaatggccacaaaagccaaaattgacaaatgggatctaattaaactaaagagcttctgcacagcaaaagaaactaccatcagagtgaacaggcaacctataaaatgggagaaaattttcgcaacctactcatctgacaaagggctaatatccagaatctacaatgaactcagacagagcgagattctatctcaaaaaacaaacaaacaaacaaaaaacagtaaaaaaaaatttttagtaagttccaattgtgtgtcagaattgtgctaggcgcagggggcaacaataagcaagacagatcaagcctataccgtcttgaaatttaagtttagggaccactctctgtcaaaggatccagcgctggtaatatagattgctgaaggcctttgccttctttccaccaggcaacagaatttgtgtccccgtcactgcttcttcttctgtgaaaaatatagcttcagtttggtccacgaatacagaagttggtcagagatattttctttcaagcacacaacaagcaaaacttggccaatacacaccaatcaaatgcacttcgtttttccctgggagctcctgccacatctcagccctgcagggcagtcttcataagggagacaaaagaagggctatgcactggcactgacagttgggcaggcagtgctcaaataagcctaaatctcaacattccaagggaatcttcaagatcaaggtagacctggtccagtcatctcttaatcttttaaggatcactggctggatgtggtggctcacgcctgtaatcccagtgctttgggaggccgaggcaggcaaatcatgaggtcaggagtttgagaccacactggccaacatggtgaaaccctgtctctactaaaaatacaacaaattagctgggcatggtggtgcatgcctgtaatcccagccactcaggaggctgaggcaggagaatcgcttgaacccaggaggcggagcttgcagtgagccgagattgtgccattgcactccagcctgggcaacagagcaagactccatctcaaaaacaaaaaacaaaaagggatcacagatctctttgaaaatcagtggcccctttagactttctgtgccaaaaaagttatgctttcacctcagcacccagttttccctagtttatctgaagtttcatggacatatgatgtgcccgaatttcctggagctccagagaccccacgtcaagaattcctagtgtatataaaagcccgtttgagctctaacatccatgattaacagtctctgggttgggtaactctgttggcttaaatacagaggcaatgacatgcctgtttaagttcagtgcaggtcccagttcaattcccatgtgagtcattatcttctgaaaatgggaaaactctgctccatagcagtggacagaacctccaaaaccagtcaggtgacacagctcatagtttctgaaaaagacaaaacaccaagctcaaaaataaggtggttggatctatggcattgcaaagcgacaacccaaaggttgtgagggttgctgcctgctgctgacatagcaataatactcattgggctcctccacttcatatacgttctcttcaatggtatagatgttttcttctgagcgaattccctctgctactgcatttgccaatcctgagggagggaggttggccaaagagatgaggctgtggaaataaagtgttgcggttgagttaagcatttcccaggtaacacggaatagagttaagagaataggctttcccaaagagacagcaactaaatatagtgcatgatctttgatcagatgctgaacaagtggaaaagccaagaaatagcaataaaatactatggggaaacaattgagaaaatgtccattaattttaattttcttaggtataacaacagcattgtgatagctaagagaatatttttatttctcggaggtgcaggctgaagtttaggtgaagtatcaagatgtctgcaattatgtacacatttagattttcaaaaaatgggccgggcgccgtggctcacgcctgtaatcccagcactttgggaggctgagcctggcagatcacgaggtcaggagttcgagaccagcctggccaacatagtgaaaccccgtctctactaaacatacaaaaaattagccagcgtggtggcatgcacctgtaatcccagctacttgggaggctaatgcagagaatcgcttgaacccgagaagcagaggttatagtgagccgaggttgtgccactgcactccagcctgggtgacagagccagactccgtctcaaaaaaaaaaaaaaaaaattattaatgctttagatagcattcaatggacagaggtttttgttttgttttgtttgatgctgggtctttctctgtcacccaggtgggaatgcagtggcacaatcatggctcattgcagccttcatctcctgtgctccagcaatccttccacctaatgtttccatttttttgtagagaagaggtctcatcatgttgcccaggctggtcttgaactcctgggctcatgtgatcctcccacctcagcctcccaaagtgctgggcttataggcgtaagccacagcacctagcccagaatcatttttgtaatccaaatatattgtattccattcatgtgccaaacatcactaaaagtctaaaatctagtaagttatgtaagccatacctatttgaaatggatgtgtgggtgtgtataatcaggaacgaaggtcaagacaggagtctataacagactagcagttctcagccctgactgttcactagaatcacctggagagcttttagaacaatttctatgcttaggcttcatccccagagattctgattcagttgctctggggttggccctgcattagtacacttcagtgcctgggtgattctaataggaaactaaagttgaaaatgcctgggctgtttacagaaatgctgagaacagatactgggtttcttgctcacttctgtaacgcctaagtgcagcccagaccctggatataataggagctcaatccgttgatgtttcagttcagtggaaaaaccattaatatcgagatgaataagcatgttgtattattagggtgataaattctataccttaactttagaactaaagaagctagaggtgtcaggaagtacacacagtagcatgttacattttcacttcataactagacctagagaaagaaggaagtataaactcagatctcaaagccccaggacaggatttctcagagaaaagatcagacatgttagagtagggacttccaagattctcaccttttcccaaccccattccattattcttaccttaaattctgtatcttctctttgctatgagaataccctagtaagggggaaacaaaagccaataaaaatgcattcataaaataaatgagacaagaaatcaaataggttcactggaagcacgcatagtttagggaaatctggtctcatctcagattgagttaaatgaaactctcaacgtgtgccttagatagttatatggactgtgttagaaaataataataaagatgcatttttcttatttaacaaatattatgagacctctactatgtgtctggcagtttgcctggcacaaggaacacaggaacataaaagtgaattgtgagccctaatttcacgaagctcacgctctcctgtgggagaccaaagaaataaaagaaaacagtaccccagacccaagaccagcctgaccaacatggagaaaccccgtctctactaaaaatacaaaattagctggatgtggtggcccatgcctgtaatcccagctactcgggaggctgaggcaggagaatcacatgaacccgggagacggaggttgcggtgagccaagattgcgccattgcactccagcctgggcaacgagagcgaaactccgtctcaaaaaaaaaaaaacaacaacaaaaaggaaatagtaaataggaaaacaaaataatttcaaattatgatgtattataaaggaaaccaacatcatagtgaaacagataatagagagggtggtcagggaaggaccctcagagatgaactttaagctcgtttctgaaatgagtcagccaagtaaagagccagaaggagcattccaggatgagggagccccttgtaaagatcttgctgagtacctgaaactgaaaacgtggctggattaagggagcggcccaagataaggtctgaaaggtaggctggggctaggtccaataagacctttccagccataatcaggagtctggattttattctaagacctgtaggaaaccttagatttccttgaagggcagagatgtgatccttatttgttttgggtttcttttacccgctgaaaacaactacgttatctcatcatttctgtgttgtgggtcaggaatccaggtgtggcttactgggtacctctggatcaaggtctttcaaggtgtcttctggggatgcagtttcaaaaatttgaaacttaaaattttcctttcttttcttttctttttttttttttttttttttttttgagacagggtcttgctctgttggccaggctggaatgcagtagtaagatcatatctgattgcaactttgaactcctgggctcaagggatctacccatctcagcttctgagtagctagaactataggtgcacactaccacagctggataattttttttaatgtttttgggctggatgcagtggctcacgcctgtaatcctagcactttgggaggcaaggcaggtggatttcttgagcttgggagttcgagaccagcctgggcaacatggtaaaacctcatctctactaaaaatacaaaaactagccaggtatgctggcacatgcccgtggtcctagctacttggaggctgaggcaggagagttgcttgaactcgggaggtagaggttgcagtgagccatgatcacaccactgcactccagcctgggtgaatctcaatatgttgcccaggctagtctcaaactcctggcctcaagtgactctcctgtcttggcctcccgaagtgttaggattataggcatgagccattgtgctcagacattgatttgggttttaatattggattcgaaggaggaataaagaaatgagaagataaattaagtagaaataatggtgtcttggagtaaggaatggccaaaagagatgcagaataatgaaaacactttagatgtatgttggaggaagactgcaggaatcttctgttgttgtttttctctgagacagggtctccctgtgctgtgtcacccaggctagaatgcagcagcaagatcatagttcatagcctcaaactcctgggctcaagtgatcttcctgcttcattctcctgagtagctgggacgataggcgtgcaccaccatacccagccctaaggaatctcaacatctaaggatcaggcagaagaagatctgaaaagcaatggatcaaagagaagaatgtcatttcagaagccaagagaaggaggactttctagaatgagtgatcaatttaaaaggttgactataataaagataaaggtatcaggctgggaacggtggctcacgcctataatcccagcactttgggaggccaaggcgggcagatcatctgaggtcaagagtttgagaccagcctggccaacatggtgaaacccccgtctctactaaaaatacaaaattagccaggcatggcggcacatgcatgaaatcccagctactcaggaggctgaggggggagaatcacttgaacccggggaggcagaggttgcagtgagccaagattgcaccattgcactccagcctaagcaacaagagtgaaactctgtctcaaaaaaaaaaaaaaagataaaggtatctgttaatatttaatttagaaaactgaaggtcagtggtgagcttgaccatttccgttgtgctttggagcagaaactagatgatggtgggtcaaggagtgtagatgggtgaaaagtagagacaactcctttgaaaaatatggctgtgagaacgagttgagaaatgggactagctggagaggaatgcatggactagaacatatattctgctaatgaaaatagcataaacagaaaaggagagagatgactcagaagaaagggataaaaagaaggatgaagtcttggcctaggcaatggagattaaaaagccctttcatatttcatcagttaggagaggggcaaagaagttttgagcagcagtgaggtatggatggtcatctcagagagtacactagaaagatggaagattgtggggcattattgagtgtcagtttgtttttgtgaggtcatgacttaaaaagctgtcaccttgattttaatattttctccagcaacttccagggaaaagattggaaatgaaacaggcctttcttatctgtacttctcagtagccatgtttttttggagtggcatatatgtgtgtgtacaaagcatcagatttcctctagatcccatcactctttatacaaactagaataagtgctaatatgtataaattatggtcatattatatatatatatatatatatatatacacacacacatatatatataaagtggtctctaatatatataatagtaaagctcaaagttttactttgagccatggcagaagtcaaaaaagtagtgagtgttatcagtgctccttaacaatccctagtctgttttggaaatactcaagtgaggctaagtgcaatgactcatgcctataatcccaacattttgggaggctgaggtgggaggattatttaagcccaggagtttgagaccagcttgagcaacatagcaagatctcatttctatttttattttattttattttatttattttttgagatggagtttcactcttgttgcccaggctggagtgcaatggcacgatctcagctcactgcaacctccgcctcctgggctcaagtgattctcccacctcagcttcccgagtagctggaattataggcatgtgcccccatgcccggctaattttgtatttttagtagagatgaggtttctccacgttggtcaggctggtctcaaactcccagcctcaggttatccactcacctcggcctcccaaagtgctaggattacaggcgtaagccaccgtgctcagcctctatttttaaatatgtatatattcatcacgcctgtaatcccagcactttgggaggctgaagtaggaggatcacctgagctcaggagattgagaccaattttctgggcaacatggcaaaaccctgtctctaccaaaaaaaaaaaaaaaaaaaaaaaaaaaaaaaaaaaaaaaactagccaggtgtggtggcatatgcctgtaatctcagctacttgggaggctgaggcacaagaattgcttgaacccaggaggcagaggttgaagtgagccaagatcacaccactgtagtccagctcccaggtgacagagtaagactctgtcccaataataataaatatatatatatatgtgtatacatatatatacatatatatatattcatgtgatcaattcaaaaattccatggctatctctgaataaacccaggtaagtgtgggtggggtagtttctttttctgaataatccatttaaccataatcgcagaaaccataaagatgaggagcaggacagtcctggtttcaaatccagtatctatcaattaactgtgtaaatgcaggcaagtgacctaaccttttagcatgctgattctccattagaaacatattagtacctatctcatagggtagttacgagaatttaatgcacgtaaagcacttggcagcttcagtccacagttagtggggggaccaactcatgtttttcttggactgttccagttttagccctagaagtcccatatatcttaggaacaccctttagtcttgagctaatctgaggtgattgctcactctacacacacagtccctgtttgtgtattagtaagaaaggctgctatgtcatattacgctctggggcataaggacttggtttctgccctaaaagaaaataaaatagacacaattataaaagtgtgtgagtggccaggcacagtggctcacgcctgtaatcccaaaacattgggaggtcgaggtggacggatcacaaggtcaggagatcaagaacatcttgcccaacatggtgaaaccctgtctctactaaaaatataaaaattagccaggcgtggtggtacatgcctgtagtcccagctactctggaagctgagtcaggagaaacacttgaacccgggaggcagaggttacagtgagctgagatcgtgccactgcactccagcgtccatctccaaaaaaacaaaagtgtgcgaggttttgggggtactggaagtatttagatcttgattgtgatgatggcttcctactgtaattctccatcaaaattcatcaacttcaacacacttctttttttttttttttttggagactgtcttattctgttgcccagggtggagtgcaatgatgcaatcaccgctcactgcagcctcctgagctcaagtgatcctcccacctcagcctcctgagtagatgggactacaggtgtgtgccaccatgcccagctcattattattattattacgttgtagaggcaggatcctgctttgctgcccaggctgatcttggtctcaaactcctgggctcaactgatcctctcacctcagcttccgaaagtgttgaaaatacaggcatgagccactgcacctggccattgtatttatttatttatttatttgcttatttatttatattttattacttttttttttaagacagtctcactctgtcacccaggctggagtgcagtggcatgatctgagctcactgtaacctccacctaccaggtttgagtgattcctctgcctcagcctcctgagtagctgggattacaggcatgcgccaccacacccggctaattttgtatttttagtagagatggggtctcaccatgttggccaagctggtctcgaactcctgacctcaaatgatccacccccctcagcctcccaaagtgctgggattacaggcgtgagccactgcgccgggcctgtttttttgtttttgtttgtttgctagtttaaaaaaaaaaaagggataagtaacttagaaaaagctatgtgctaagtaccatgatggaggaaaacattctctaaccccagtcacgacccagtgttaaagggacttgcagtctactgccagagaggtatgcctgagaaaccaataacagaaaagtgcacagaaggaagtgttttttgttgttgtgtttcgtaacaaacctagacatattcatgaattaaagaaattagtttactggaatcagcctgcctggatttgatttccggttctgccaggtactgatgttgaaacctcgggaaggcagcttactctaagcttgacttcccttcactgtaaaatggggatggtactattccttatctcataagacagtaatgatgataaaatgtatgtaaaacatttaacgcagtggctgcctgacacacaataaatattaaataaaaattagccattattgttaggatttggatggacaaaagggtatttagtctaatcatctttgggtataaacatgaatttgcatttctatctaggtttttactggttctcactgaagaatttgttatcagagggagagagaaacaaaaacacttacatttgaaaattaaagcgccgaagataagagccagagccagcccagcacagatccctgctccgatgtagatgcctattctgatggttgctccagagtcccgtaagtcattggccaatctagagtcccgtaactcattggccaatgtggatatttgctatggaaacacaaacaggatttaagcagaaaacagctagaaatcgcttgtgtaatcagcttcaagatttgtgaattggaccatcccttttacaacatcacaggatggctgagtccttcaaatcacctttgatctgtcaccttgtagccaacactcaagccaacccaagaaagggtctcccttaacctttggagttagcaaggaaacaaaatgtgcccttctgtgttgtgggtagagaaggagctcttaaaaaaaaaaaaaaaaaaagagagaaggagctcttaagaccctttccctgcccctgcaaaaattggctttagagtggagtcttgttggttcaagatcccctaagattccccagagagttttagagtagtttacatttagtgtcttgctatgaaacgtctatttttcacaaaaagacagtgattcaatagccaagactttacagccagacggtcgtggattcaaatcccagctctgaggccgggcgcggtggctaatgcctgtaatcccagcactttgggaggcctaggcaggcggatcacctgacatcaggagtttgagaccagcctggacaacatggtgaaaccccgtctctactaaaaatacaaaacttagccaggcgtggtaacacatgcctgtaatcctagctagtggggaggctgaggcaggagaatcacttaaacccaggaggcaaagactggagtactcgagttgagatcatgccactgcacgccaacctgggcaacagagcgagactccatctcaaaaaaaaaaaaaaaaaaaaaattcccagc

SEQ ID NO: 291 - DNA, 2907 bp, Homo sapiens
  cDNA HAVCR2-001
agaatattagaacagagagccatgcatgtattatctaatacaattttctcattttataaattatataaatgaggaaactgagactcagcaaggttataggatacaacctaatctgtgttagaagaaggatgagagtgaggcttatgctgggagttgctatggtctgtaaatgtgaggataaggaacatgccattcactgttgtgttccacttcctagtccagtgcctggtgcaaagtaggggcttcataaactttggtcacaggcctgatgaagggactgatttgagtgaatgaatccatggatgatgcatctgtactttgtgttccccgctagtcagatggactcggacatgctccatttcaggtgtatctcatctgagacattattagagggttctctttatgtgccatgactgagtagcgttttcttccactgaagtattgcttcctctttgttgatatcacaggacagacatcagaacacttacaggatgtgtgtagtgtggcatgacagagaactttggtttcctttaatgtgactgtagacctggcagtgttactataagaatcactggcaatcagacacccgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 292 - DNA, 975 bp, Homo sapiens
  cDNA HAVCR2-004
gtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccacctta

SEQ ID NO: 293 - DNA, 566 bp, Homo sapiens
  cDNA HAVCR2-007
gtttcggctgcagaggggaaggcggctaccagtgtaaagccagagctgagggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgact

SEQ ID NO: 294 - DNA, 566 bp, Homo sapiens
  cDNA HAVCR2-005
aattctctcctagggcagtgtttctgaaagtgaggttctgagaccagccacttcagcaacacttgagaacttgttagaaataaaagttctcaggctctaccacaggccaactgagtcaggaactctagcagttgagcccagcaatctgtgttttcgcaaggcttcccagtgattctgatggccttcacatctgagaagcattgtcacagcgaatcatcctccaaacaggactgcagcagtagcttcctctttattctggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaat

SEQ ID NO: 295 - DNA, 1010 bp, Homo sapiens
  cDNA HAVCR2-002
actgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccaggtgagtggacatttgcatgccatctttatgaataagatttatctgtggatcatattaaaggtactgattgttctcatctctgacttccctaattatagccctggaggagggccactaagacctaaagtttaacaggccccattggtgatgctcagtgatatttaacaccttctctctgttttaaaactcatgggtgtgcctgggcgtggtggctcacacctctaatcccagcactttgggaggctgaggccggtggatcatgaggtcaggaattcgagaccagcctggccaacatagtaaaaccttgtctccactaaaaatacaaaaaattagccaggcatggttacgggagcctgtaattctagctacttggggggctgaagcaggagaatcacttgaacctgggagtcggaggttgtggtaagccaagatctcgccattgtactccagcctggctgacaagggtgaaactctgtctcaaaaaaaaaaaaagaaaagaaaagaaaa

SEQ ID NO: 296 - DNA, 795 bp, Homo sapiens
  cDNA HAVCR2-006
gtttctgaaagtgaggttctgagaccagccacttcagcaacacttgagaacttgttagaaataaaagttctcaggctctaccacaggccaactgagtcaggaactctagcagttgagcccagcaatctgtgttttcgcaaggcttcccagtgattctgatggccttcacatctgagaagcattgtcacagcgaatcatcctccaaacaggactgcagcagtagcttcctctttattctgtaagacatggcttgcagttttcctgaaatggagtaacctcactcaccgcttgagtcttggctctccttctctctctatgcagggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatcca

SEQ ID NO: 297 - DNA, 11592 bp, Homo sapiens
  Coding Sequence of the CD40 Gene
ggctggggcaggggagtcagcagaggcctcgctcgggcgcccagtggtcctgccgcctggtctcacctcgctatggttcgtctgcctctgcagtgcgtcctctggggctgcttgctgaccgctgtgagttgtttttgccccgaccagacgggagttgggagtggggaatgagaaggaaagggaaggaagacttcggggaagaggccttcctggctgatttttgtgggggcaggagggtgggtgggagctgggcaaggtgcccccgctcctggctgaatggggtgggctgcctctctcttctcccgggctggggtcccgggagcggcctacaggggccgctcagggaaggcactggctgcccaagcgtgcctagacggcctggacgggtttagggagcctcagaggctggccacacagagactggtagggggttcagagggcgggaagtgaggcggaccaagggaaggggcgggtctggcccgtttcctgtccccttcttattgtggacagatgccagcctctgtaagtagttatcatctccttgccagctggggctgccttcttccagggcatcttgtgggaacaagagatgggtgcagaggcccaggtacttttgtgagaaggcaaggagcttttaacatcgccttccaccccgaaccgtatcttgggtgttccaacctaggaggaatccccagggctttgcctttttctcctgaatttaagatgacataggagacccctggggagatgaacagtttatgggacacaataaagggttaggagaccagagttctggttggctctgacagggctggtgatcagagggctggagaaaccaggggtttctccaggcaccagaggggctcagagccaaccaagcatatctccgggattttcagaagcctacacttgactcactttttgtttaaatgtatttttgtagttcctcattctggaggctgggaatcccccaagtacctggctccttcatcccagcccctctggcctccccctactttagagggctgtagattcctgcctgaagcctgggcaggaatgacccatggtatcaaggaaagcaagggaagcagcaagggaagagagggagtggggaggctgctttggtcccacagctttcactttcacctgaagcaatggctcttagggaacagggaggcagggggagggcggagctggaaagaggtaaaggggggcccttgtggtaggagtggagaaagagccagaggaggtggggtgaagggtgtgatccaggcttctcaagagcagagtttgccctcataactcccaactttggctccaggtagaggctgggctgtgacaacaatgtcagaagctatctattgagggcttcttgtgtgtcaggctctgagccaaacactgcctgttttctttgtctgatttctcacaactcccccattatacagatgggcaaattgaggctcagaaagggggattgtcttgccaaaggtctcatagctagctaatggaagaacctggttgtgaatctacatctgcatgattcccgagcctgcctctcagatagtgagagtctccaagctctggtcctgagctgttttgtggcagaaggaccagaactatggggagtgagaactggagattgacagacttttaggggagcgttttatttctcatgtgtttgaagatggtatcaaggactttcctatctttgggagtgtgggagctccacgttcacaggatggtgtcttgcaatgagctggtggggggcagtagccttttctacttcctttcccattttgggtaagacacatttctgtaagtaatttgctgagatacccaggttgaatgagagccaccagttaggtaggattctggacagccagccaggtagccgggctgcttgccatatatcatgcaagcagaaacaaatgaatgatgattaaaattgccatttaatgagcacctactatgttcctgacactgtgctaggccatatacatgtattctttcttatcttcgtaatccaacctgcagggcaggcattattactcccattttagagatagagaaactgaggctaagagaagcaaaataactagtaagtgttacaaagtcaggactggagtctaaagctgtctgactctcaaacttgtgttcttttcactggctgttcccaaactgtgggacagttttaaggagcacatggacatagaattaaacatacacttactttacagttcttttaaaaatccttctcattttttcaaagaggaagtctctggagctagaatagagttaatgcctctcaaaggcttgctaatccttcttttaaaacaaaaatcaagagcaggcctgggagggccttcaacaagcaaacaaccagctgggttttaataaccttgttttgtttccccagaatttatttttagggttaccttttatttatgagaagtgatactggttcttgtctcttggcaatgatgtgaggtttacatttaaagtaaatgtaccggccaggcacggtggcttgtgcctgtaatcccagcactttgggaggccaaggcagtcagatcacttgaggtcaggagttttagatcagcctggccaacatggtgaaaccctgtctctactaaaaatacataaattagccgggcatagtggtacacacctgtaatcccagctactcaggaggctgaggctggagaattgcttgaacccaggagatagaggttgcagtgggctgagatgatgccactgcactccagcctgggcgatggagcgagactctgtctcaaaaaataaaataaaagtattgaaattaacaataagtaattaatagcatgggtggtacctggatgtagtaaaatggtgaagatgaaacacaagttgatggagagaggagcattgagacctgagttctcatttggactctgtcactgtgagactctgggcaagtgaccctcctctttggtgctcagtctcaactatctgtaaaatgaaagtgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccaggggagctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggtgagatgccaaccctctagccccatcatggagtccccctttgctttggtggcagacgcagaccccatatgttaactgtaaactcaaatctgaaacgacccatttcccagccctgcttcactgtcagaatgttctggttccctctctaccaggtaaaactctgtctaccctgaactagggatcccagcttctccatcttcctcgcctgattatgaaggatccaagactttcatctttgaatcccctaccctaaagcctggcctgatcattgtgtggttagtgtctgactcatggagttggccagagccctccctcatttcctgatgttttccaggacagaaactggtgagtgactgcacagagttcactgaaacggaatgccttccttgcggtgaaagcgaattcctagacacctggaacagagagacacactgccaccagcacaaatactgcgaccccagtgcgtgcgctgttgggaaagggacgcttgggaaccgggctgatattcccgacaatgcagccattctaattttatgtagccagggtctgctctgattggttggagtccgggctgtactgatcattaaatgatttgattgccatctctacttggaagagggtctgaggaagaaagagcaggcaatgtggggagtgaggctcagagcatggcccagcagggggttcccatccttcctgcccttctcttctcagacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaacaaacacctgccccattaactttttgcatttgatttttaaaaatgggcaagataggcacatgggacagaaggcacaaaagagccaaagtgatgtctttctcccatccctgccccttaggctcccagttctttctggagggagccattgttccttgcatatccttccagagattctacatataaacaaaccaacacacacacacacacacacaaacacacacaaaatttccctccttttacttttgcacaaataggagtatacattttatttgttaactgtctgcctttccctaatagattgaaaattccttaaatgtagaaacttggccttttttttttcttccattgatacatcccctatacctggaacagtacctgacgcatggtaggtgcttaaatttttactgataaatgttgactgataactggaggcaccactggtatagtttttttttttttttttttttttttttttttttgagacagagtctcactctgtcgcccaggctggagtgcagtggcgcaatctcggctcactgcaagctctgcctcccaggttcacgccattctcctgcctcagcctcctgagtagctgggactataggcgcccgccaccacacccggctaatttttttgtatttttagtagagacggcgtttcaccgtgttagccaggatggtcttgatctcctgacctcgtgatccgtctgccttggcctcccaaagtgctgggattacaggcgtgagccaccgtgcccggccaccagtggtatagtattaatggaatcagtgcattggcttacgtatctgattacagctcagtaagtgtgtgaccctcactgagcctcagtctcctcatctgaaaaatgggaatgaccttcatttcacaaggcttgagctaaaaacatgtaaagtgtattgtaaattcctgaatgctctactcatgtaagactaaagtaggccgggcgtggtggctcacacctgtaattgcagcactttgggaggccgaggagggcagatcatgaggtcaagagatcgagaccatcctggctaatatggtaaaaccctgtctctactaaaaatacaaaaattagctgggcgtggtggcgcacatctgtagtcccagctactcaggaggcggaggcaggagaattgcttgaacctgggaggtggaggttgcagtgagctgagatcgcgccactgcattccagccagtctggcgaaagagcaagactctgtctcaaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcagtgagtcctcaggtggggaggtgttgggggagggaggggagaccacctgtttcttatctggcctctccaactccccatcctttttttttttttttttttttttagaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 298 - DNA, 6707 bp, Homo sapiens
  1st Promoter of CD40
attatgtacctaggactgggatagatccagtcctgccctcagggagctcacagtcaaatgggaccaggcagaaggagttatgagctggcatgctaaatgctgtggcaacacaggggaggaggcagggtgggatagagtacctacctctgcctcagggagttggggaaggtgtaagaggaggcaacatttaaactgtttaagaaaggagaaggaaaggaaggaaacatcaagagcaatgagataaaccgtaaggaaaaaagattgtgtgcctgggaagtggggagaggctgaagccagtgtgcatgggaggacgtggcaggaagtaagcatagaaagagaggttggggctgagtgaggaagggtgtgctttgccaggataagaaatttggatcatcctgagggtgcagggaaacccaaagaggcttttatgcaggaaagtgtcccagtcgatcagatctggagtttatcaagagaatcgcagcagtgtaaagagttgcctggcacatagtaggtgctcaataaatcctgtggaatgagagaggctgttgggacagtccagatgaaagatggcaccctctgaattagggcagtggcagaggtgacagaaaataagggatggatcctagaggcagaatccacaagacttgcaaatgtgcccttaacagcagaagccatgagaatggggttagaagtgtcctcctcttccatcctccctgatctgtgaggtctggcctcttgtcctcttccagaaattgagagcttggagggtcatcacctcaaccgttgtctagttcaagctcctaagttttccttggagaaaaatttaggcctaagggaacacagtccttcagaggcagaggctgcaccagaacccaggtgttccatgctgcaaagcagagtgttaacactggttcaagaacatcttgagggccaggtgcggtggctcatgcctgtaatctcagcactttgggaggccaaggcaggcggatcacctgaggtcaggagtttgagaccagcctggccaacgtggagaaaccccgtctctactaaaaatacaaaaattagctgggcgtggtggcgccagcctgtaatcccagctactcgggaggctgaggcaggagaattgcttgaacccaggaggcagaggttgcagtgagccgagatcatgccactgcactccagcctgggcaacagaatgagactctgtcaaaaaaaacccaaaaaccaaaaaccaaacaaacacccaaaaaacaaaacgaaacaaaaaacaaaaaaacaaaagcacgtcttcagagttcatgaacccaggaaatgtaggcacaagtgtgtgtgtttctgcaaaatgagagggtcccgagtttcctaacatacttaaagtgttttatgatgccacaaaaggctggcccactctttttttttttttgagatggagttttgcactgtcgcccaggctgaagtgcagtgatgtaatcattgcaatcatggctcactgcaaccttgacttcttgagctcaagcgatcctcctgcctcagcctcctgagtagctgggactacaggtgtttgccaccatgcctggctaacttaaaaatttctttattttgtagagatgggggtcttgccatgttgccaggctggtcttgaactcctggcctcaagcaatctccctttttggccttccaaagtgttagattacaggcgtaagccaccgcgcctggcccccacctttatttttatttttatttattatttattttttttttttttgagactgagtcttgctctgccttcgaggctggagtgcagtggcacgatctcggctcattgcaatctctgcctctgcggttcaagcgattctcctgcctcagcctcccgagtagctgggattacaggcgaacgccactacatccggttaatttttgtatttttagtagagacggagtttcactatgttggccaggttggtctcgaactcctgacctcaagtgatctgcccgcctcggcctcctaaagtgctggattacaggcgtgagccaccgcgcccggccccactcttaataaatgcctgtctccaggtgctgggtgggaggtgggatggaatggaatgaggtgaggacgcatggatgcatggatgaatggatgggaagttgagacgacgcgcccacacgagggaatttcctttgaaagagagcgaaattctgagttgggaaactcttccttgaaacgcctccccataccccagctgtggccttcccgttttctgcgtggtggtgtggggggaacttcctcaggcctctccgcagtggagcctctttcggttctgccaggatacctagaggcagcggagagcggggcagggaggggaaaaccgtgagggtccctgtggcaggccccagcacccatgggatctctctccggtcgcaggaagcaggctagctcctagcccgcctcggcttggcctttgtgggacctgggggcaaagaagaagagctgtctctgggaccatgcctcctcccgtacacagcaagatgcgtccctaaactcccgggggaattagacttgtgggaatgttctggggaaactcctgcgcggtgaattgctgggggctccgcccccccgataggtggaccgcgattggtctttgaagaccccgcccctttcctgggcggggccaaggctggggcaggggagtcagcagaggcctcgctcgggcgcccagtggtcctgccgcctggtctcacctcgctatggttcgtctgcctctgcagtgcgtcctctggggctgcttgctgaccgctgtgagttgtttttgccccgaccagacgggagttgggagtggggaatgagaaggaaagggaaggaagacttcggggaagaggccttcctggctgatttttgtgggggcaggagggtgggtgggagctgggcaaggtgcccccgctcctggctgaatggggtgggctgcctctctcttctcccgggctggggtcccgggagcggcctacaggggccgctcagggaaggcactggctgcccaagcgtgcctagacggcctggacgggtttagggagcctcagaggctggccacacagagactggtagggggttcagagggcgggaagtgaggcggaccaagggaaggggcgggtctggcccgtttcctgtccccttcttattgtggacagatgccagcctctgtaagtagttatcatctccttgccagctggggctgccttcttccagggcatcttgtgggaacaagagatgggtgcagaggcccaggtacttttgtgagaaggcaaggagcttttaacatcgccttccaccccgaaccgtatcttgggtgttccaacctaggaggaatccccagggctttgcctttttctcctgaatttaagatgacataggagacccctggggagatgaacagtttatgggacacaataaagggttaggagaccagagttctggttggctctgacagggctggtgatcagagggctggagaaaccaggggtttctccaggcaccagaggggctcagagccaaccaagcatatctccgggattttcagaagcctacacttgactcactttttgtttaaatgtatttttgtagttcctcattctggaggctgggaatcccccaagtacctggctccttcatcccagcccctctggcctccccctactttagagggctgtagattcctgcctgaagcctgggcaggaatgacccatggtatcaaggaaagcaagggaagcagcaagggaagagagggagtggggaggctgctttggtcccacagctttcactttcacctgaagcaatggctcttagggaacagggaggcagggggagggcggagctggaaagaggtaaaggggggcccttgtggtaggagtggagaaagagccagaggaggtggggtgaagggtgtgatccaggcttctcaagagcagagtttgccctcataactcccaactttggctccaggtagaggctgggctgtgacaacaatgtcagaagctatctattgagggcttcttgtgtgtcaggctctgagccaaacactgcctgttttctttgtctgatttctcacaactcccccattatacagatgggcaaattgaggctcagaaagggggattgtcttgccaaaggtctcatagctagctaatggaagaacctggttgtgaatctacatctgcatgattcccgagcctgcctctcagatagtgagagtctccaagctctggtcctgagctgttttgtggcagaaggaccagaactatggggagtgagaactggagattgacagacttttaggggagcgttttatttctcatgtgtttgaagatggtatcaaggactttcctatctttgggagtgtgggagctccacgttcacaggatggtgtcttgcaatgagctggtggggggcagtagccttttctacttcctttcccattttgggtaagacacatttctgtaagtaatttgctgagatacccaggttgaatgagagccaccagttaggtaggattctggacagccagccaggtagccgggctgcttgccatatatcatgcaagcagaaacaaatgaatgatgattaaaattgccatttaatgagcacctactatgttcctgacactgtgctaggccatatacatgtattctttcttatcttcgtaatccaacctgcagggcaggcattattactcccattttagagatagagaaactgaggctaagagaagcaaaataactagtaagtgttacaaagtcaggactggagtctaaagctgtctgactctcaaacttgtgttcttttcactggctgttcccaaactgtgggacagttttaaggagcacatggacatagaattaaacatacacttactttacagttcttttaaaaatccttctcattttttcaaagaggaagtctctggagctagaatagagttaatgcctctcaaaggcttgctaatccttcttttaaaacaaaaatcaagagcaggcctgggagggccttcaacaagcaaacaaccagctgggttttaataaccttgttttgtttccccagaatttatttttagggttaccttttatttatgagaagtgatactggttcttgtctcttggcaatgatgtgaggtttacatttaaagtaaatgtaccggccaggcacggtggcttgtgcctgtaatcccagcactttgggaggccaaggcagtcagatcacttgaggtcaggagttttagatcagcctggccaacatggtgaaaccctgtctctactaaaaatacataaattagccgggcatagtggtacacacctgtaatcccagctactcaggaggctgaggctggagaattgcttgaacccaggagatagaggttgcagtgggctgagatgatgccactgcactccagcctgggcgatggagcgagactctgtctcaaaaaataaaataaaagtattgaaattaacaataagtaattaatagcatgggtggtacctggatgtagtaaaatggtgaagatgaaacacaagttgatggagagaggagcattgagacctgagttctcatttggactctgtcactgtgagactctgggcaagtgaccctcctctttggtgctcagtctcaactatctgtaaaatgaaagtgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccaggggagctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggtgagatgccaaccctctagccccatcatggagtccccctttgctttggtggcagacgcagaccccatatgttaactgtaaactcaaatctgaaacgacccatttcccagccctgcttcactgtcagaatgttctggttccctctctaccaggtaaaactctgtctaccctgaactagggatcccagcttctccatcttcctcgcctgattatgaaggatccaagactttcatctttgaatcccctaccctaaagcctggcctgatcattgtgtggttagtgtctgactcatggagttggccagagccctccctcatttcctgatgttttccaggacagaaactggtgagtgactgcacagagttcactgaaacggaatgccttccttgcggtgaaagcgaattcct

SEQ ID NO: 299 - DNA, 9166 bp, Homo sapiens
  2nd Promoter of CD40
atcatgccactacactccagcctgggcaacagagcgagattccatctcaaaaaaaaaatcctttgagtctttgccactaccttgcaaagtaagtacctcatactttcattttacagatgaggaaactgagactcaaaaagatagagtcattttatttctcactgttaagtgatatagtcaggatttaaacccatttctgtgagactactaagcccacatgttccactgtacctggcagggttaattacaggtaccatggaaatatagcctgggagagctggtggtttatcagatacctttctatggcatccatcaggatcaagtagtttggaaagaaattattacttttactgtttttgctgtggggtgacagaactgtgcggggaatgtctttatggatgtgaaattcacgtcagcatttggaaaactccattagccactattgtctagactagggagttaaaagtaggaagcaagagataaaagaatacatgggtaggaaattctgtgttggctcatgctgaaacggaaagaatcattattttgaaaccattaatgatgaacttggtaaggatcaaagtagtctcgtgatctgtaaatctaatgaaatgaaaatgaggtaatggtatgttttataactacggaggatctgagaagctggaaattatctcagcgtgaatactgtaagagaagagggaacaatggaagccatctagaaaagaatctttattcagctttatttatagcaggtattcgtcttgtctttcaatacagggatcacaaaggagtttgtttcaccttgctgggtgtatgaaaatacaacagttgtcacagtccctgctgcttccttccatggaacttaacacgtacaaaggagggaaaggtggagacctatgatgagggggatgaatagctcaggctgggaggggagactggaggtaagagagactggggagaagaaaagacctaagagagattctttccaccatttcccaaccccctttctctaattttttacttaaaaaaaaaattttttttttacagagatgggatctcactatgctgtccttactggtctcaaactcctaggctcaagtgatccttcctccttggcttcccaaagtgctgggattacaggtgtgagccactgcacctggccccaaccccttttctctagacctgagctatctaacatagtagctaccagctatatgtggctttttacatttgataaaagtcaatacaataaaacccccactttcttggtggtactagccacattccagatgttcaacaagcacatgtagctagtggtagctaccatattgaatggcataaatatacaatgtttacatcatcacagaaagttctattggacagcacaaatcaacactccaatccacctagatgtttaggagtatttaaagcctaggacaagggaaatcccatgactgtaacatccctggcccaaaggatgacagagaatagagtctttgaaatggggcataagggtcccagtttcctgggtgaccataggctagctacttctgttctctagaactcagttttctaatattaaagagtaataccattttttattagacattatgtgagaaaatcacatagttaacttagtccttataataaccatgtgagctcttaggctcatttcacagagaagaaactagaagttaagaatatgctcaaggacacacagtcagtaacagaatcagattttgggccaggcctatgacttcagaaattacacttttactcatcgatcgatgctgcctcctgctgctagttcctcatttgtaaatcaaagtgcctttgctgtattctcccagaaacagaaactgagacaaagatttgagtgcaagtagcaagtagtttctttgagaggtgactccggggagcactgatggggtaatggggaactgagacagagaggagaaggaagccattacagggtgggtgaatgagcaggttacacagtgggcaactgtggcttcaccttgactggacagacagtgtagaacacataccttttagttatcccagctgcggggaaaggcagctgcggcattgatccaccaactcctcatctgtcattggtagaaggctgcattatctccagcccttctggcctgccctctgaagggctaaacatgctcttgtggccaaaaaaggctctggggcagaaggtcacaggtgcttgagataggggacaggaagagtgggaacagtgaatatggaaggcctgagggtggagtaccaacaaggtgctacatggggattggattaagtcctctttctgctctaaccaattagtggctagcggtgctagtactaggtattattaggtatttttacatcataaaacctgaaagcataatgactacaatctaccagagcagggatccccaacaccccggctgtggaccggtaccagtccgtggcctgttaggagccgggcgcccagcaggaggtgagcggctggctagcgagcattacaggctgagctctgcctcctgtcagatcagcgatggcattagattttcatgagactgcgaactctatagtgaaccgcgcaggtgagggatctaggttgcgtgctttttatgagaatctaatgtctgatgatctgaggtggaaccgttttatccaaaaccaggaaccatccttcccaacccctctatccgtggaaatattgtcttccacaaaactggcccctggtgccaaaaaggttggggactgctgtaccagagcctatctgtagaggagagactggagatacaattagacatctgagctgattttcaacatggatgacagagtaaagggttaatattcagggctgggattttgtctagttcacgtgacctagtaagtgctcaatgcatattagttgagtgactacatgattgaataaagttaatatgaaacagacaatttaatagaaaatggacaaaggatatatacagttagttcacagaggaggatatccaaatggttgataaacatttgataggatcctcaacttccctaataattgaggaaatgtaaataaatgcagcaaagagatctctctcttcaccatcaaatggtcaaatattaaaatgaatgataacatttagtactggggagaaggcagagtaaaggtcccttcaaacatatgaatttcccaaggtttttggaaagtatctttaaaatatctgttagcatttacaatataaatacccacaaattccttctagaaatctattgtatagaaataaaaacacacgtgcctaaccatacgtgtaaaaacattgttgcagcctgctttgcagtagagagaacctggatgcaacctgaatgtacatcaacaggaaaatggttaaattgattgtgacaagtccacaccatggaatcttacacaattattttaaagaaagaatgtgtacgatctgtatctactaacctggaattatttccatgatatattattaagtgacaaaaatgactgcaaaaaaagatagagattccttttcttattaaatgaacaaatatattcttaaatgtgtagacagatatttatcaggctattatggggagagaggtgtaaagatagataaagaaaaaaaaaatacatgccaaggcgggaggattacttgagtccaggggtttgaggctgcagtgagttatgatagtgctactgtactgcagcctgggtgacagagtgagaccctgtctccaataaaaaaaataggaaaagaaaagaaaaaataaaaataggagtttataaaggtggaaataatatacgtggtctaatattataggaaaatgtaaaatagataatctatttatgatatcccttggaaagaaaaatctgaaggtccctataggcaaggattaaaaggtggcacacgcaaatgtacaaaccaaaatgctgatttcattatgagatgggaccatggatttttttggtctgtaataaagcgcctgtttcatatttatcttgagtgggaaagtctcgattactcactgggctatggctgcatgaaaatatacagaattgtatctctagatcctgattctcaaagtgcttttttcttttccccagctaattcactgggcagaagttgccttctaatgggtctttcttcacggtctggcatttttaaggcaatcagaactttgaggatgttttccctgcattattgggccaaaaactatctgccctctctggttcttacgtttggtgtgtgcccaaaattaggaagagcaaggggaaaggagaaaaatgtcatcctgcatagagaacaacaagttgtgccgagtgttctgagggaacattgcagggcagatggattgttctggatgttcaggatgtgtacccttcttacttgaggggaaggagggcaggaggcttgacaaggaagccaaggaggcatagaatgtgcgttgtaagccaagtgtggccactctgattcctttcccaagactttgaacctcgaaggagtgatgctcaagttcaggggtagttagagattgtgttcattatctattgctgggtaagaggttgacctgaaacttagtggcttgaaacaagaaaacatctattatctcacagtttctgtgggttaggaatccagaagcaacttagctgggtggttctgattagatcaccactgggatcaatgtgtcagctggggctgaagtcatatgaggcttgactgctgcgggagggtccacttccacttccacttccactttcacttcctatgtggctgagggctggaagctttgaatccttgccatatggacttctccataggctgcctgagtgctgagtgtcctcacgacatggcagacagctgcttccccagagggcctggagacagtgcagggggtgggggagaggggagagagagagagagagaggagagaagagagagaaaggagagagagaagagaaggagagagaaagaagagagagaaagagaagagagagagaaaggagagagaaagaagaaggagagagagaagagagaaaggagagagagaaagaagagagaaagaaaagagagaagagaaaggagagagagaaaggagagagaagagagagaaagaagacagagaaaggagagagagaagagaaaagagaagagagagagaagagagagaggagacagagaagggagagagaaagaagagagagaagagagaaaaagaagagtgagacagtgcacacataagatggaagcctcagtccttttatttttatttaatttttttgtagagatgaattattgctgtgttgctcagctggtctagaactccttgctttaagtgatccttcctttcttgacctcccaaagtgttggaattacaggcatgagccactgcacctgacctcagtgggtttgtaacctaaccttgatgtgacctacactcacttctgctggtttctgttggtcacacagaccaaccctggtacaataaggaaggggactacataagggtgtgaagaccaggaggtagggattgttgagggctgtcttggaggtaggctggcacagagatggtttatagaacttttctgtggcagagtctcatctattccctgcctcctgtggttttgcctgggtgcctcccttgagccttcctgtcggctctctgggctgcccaacaccctttcaatagtgtcctcttttatttaagttcactgctacatcttctcttgtttgcaaggacaactctgattagaacaggtgctacaagagaggacagtggcgggggaggtgggtgggtagcagaggaaactcattttagataagatggtcagggaaggcctctctgaggaggggccacttaccctgagacatgaatggtgaggaagagtcagcagatgaaaggtgggaggaggggcgttttagacagagggggcagcatagccaaagctctgcggtgggaaccaaggttgccaatggccaggtcacgcagcctcttgaggtcacagtaaaaacttggatcctttcccctgcaaccaaagcatctcttcttccaaacatcagagtctgggagggctgaggaccaggctccaggcctcattgtgcggggatcagatcagccgagtaagtggctttaaccagataaggatcaagacattctctgctttgttctcgcatctgttttgccggctcttgggttttccaaatttctgcttgggttcttttctgagtttcttagttccctttgataaattcccacgtgatactggtgagctaaagggaaagctttttgtccatagttaggcctgggaatcccagctagagagccctgtcatcttatggagatgggctgctacccaggacggtgtgggaatgggcaggtgggtctgagggatcccttcagcctcattactctatagttctgcgtttattcaacaaatacctgttcagcatctggcaggtgttcagactctgtgtgggtgttaggttaagaagataaaggaggcactgttcctcctctccacaattcaagttagaagtgagggatggcctgatccaaaggcgattgagtgcaaattccttgttccttaggaatcagccacatggctggcccacagccaaagccaacaggtcctctgtaccctgtattttagggagccagatagtttccctccaggtttactaaaggaggcagaactcgctttacacccacagcccaaaattccaatttcctcttccttgcccatacagcaatcttggggaggaaggaggtccttggttttactgagtagtcaggtgttcataggagaaggccatttcctccctccccgttaagggtggggtagtggaaattcaaaggaagtccctcatggagactgagaggtgactgcaagcatggggtgctgggatgctgttccctgatgggtggtggactgtgggcagtggactgtgcctatctgagcagggtagaggagaggtgagaagaggggcattgtggtgtagctgactggatgcgtgagcttctctaggtcaagtggacgttgcagtaatcagcctggctggagcacttttctggtggcctactcaagcaggttgactgctgggcaagagggtcaggacactggtaggccctaggtggtggggtggggtaggcgaggtcaagcctgggctggatgaccctgtgagagaattgtgcagtggagaagccgctaaggaacttactcatttgcccatgagaaaccatatatggacacggggttggggtgggggtggtagggtatgtctcccaatcagaccatccgccccacctccaccaagtccttttcctcctagcaggcagggtcctggctcaagttaactcttgaatgagtaagagagaagataaaatgagatttaaattgagtttgagaataaaggtctaaaggatggaggtttaacaacagaaagtgatccaaaagtaatgcaatctgcccaaaatgtcattaagggatggaaaagggagattcaacacagcatggctgaaggcagagattaggggagaaaatcttcatcattataccccacagagttgaatcgcctcaatacactggctccacaagtaaacagaaaaattgaaatacagtgtggtcgggctagagtcttgcttgggtaaagctgccccaggttctgagagagcacagggggataggttggttgttagagagagatttccagaggagggttgcctgagatggaccttgaagggtgagaaagagttggccaggtgaaaggagagtggcagtgggaagggagctctccaggcagaggtgacagcacgggacatctggggagtggggctggagcatgaaggggaaggcaggaaggatgcttagagatgtacaccaggaggcccatggccttgcagctctgcaagcttaaggggtgagggccctggagagccactttaaaccttggagcaacacaattggatttgcatattagacagaacactctggatgccagattctggcagcgctgtggacactggacctctaggcatgctcctcacccattcacctggcactgtgaacccacctccctacaaaggccatttcatctctgagtttccaaaatcctggctccctactcttttgaatgtcctttgccccattcctattgcagaacccttcattgttccctttttgattggcctccgaatattgccactttcccttaaatcatcttctcgctttcctcctccagcacactcttctcagctcaacaagattctaggccttctctgggcctgtgcccaccagcacatgcctcctcaggatatgtatatactaaaatatcttccctttatcttatctggtcttcgccccatggggcaacccgaaggctaacatttattccttcacacattaatttaagctgctttaattgctgctatgatatgttttatataatataattaatgttttaattctgtgtacttgcttccccaggcagttttgtgaaaggcccaattttggaatcaagcaaataaagaataagtaatggctgaaatcattatagtaacacccctctctcaaaggatttaaaaccgtgcttgtttttttcaaagtatgttaaaaagggaaaagatattttaatcttctctccatcctgggcatgtttgggtggctttaatgaagttccctggaccctgatttcaagagtttctggccttttggtatctgaccaccattctcaagaggccactgcagcttgaggtctgtgttgagattaccagcttcgcaccccctgccaccaactctttgtcatgattggaggctgtacttaggatgagaagttgctgaacccactcattcatttattcattcattcagcacccatatattggtgtcctattatgtacctaggactgggatagatccagtcctgccctcagggagctcacagtcaaatgggaccaggcagaaggagttatgagctggcatgctaaatgctgtggcaacacaggggaggaggcagggtgggatagagtacctacctctgcctcagggagttggggaaggtgtaagaggaggcaacatttaaactgtttaagaaaggagaaggaaaggaaggaaacatcaagagcaatgagataaaccgtaaggaaaaaagattgtgtgcctgggaagtgg

SEQ ID NO: 300 - DNA, 21818 bp, Homo sapiens
  1st Enhancer of CD40
tgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccaggggagctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggtgagatgccaaccctctagccccatcatggagtccccctttgctttggtggcagacgcagaccccatatgttaactgtaaactcaaatctgaaacgacccatttcccagccctgcttcactgtcagaatgttctggttccctctctaccaggtaaaactctgtctaccctgaactagggatcccagcttctccatcttcctcgcctgattatgaaggatccaagactttcatctttgaatcccctaccctaaagcctggcctgatcattgtgtggttagtgtctgactcatggagttggccagagccctccctcatttcctgatgttttccaggacagaaactggtgagtgactgcacagagttcactgaaacggaatgccttccttgcggtgaaagcgaattcctagacacctggaacagagagacacactgccaccagcacaaatactgcgaccccagtgcgtgcgctgttgggaaagggacgcttgggaaccgggctgatattcccgacaatgcagccattctaattttatgtagccagggtctgctctgattggttggagtccgggctgtactgatcattaaatgatttgattgccatctctacttggaagagggtctgaggaagaaagagcaggcaatgtggggagtgaggctcagagcatggcccagcagggggttcccatccttcctgcccttctcttctcagacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaacaaacacctgccccattaactttttgcatttgatttttaaaaatgggcaagataggcacatgggacagaaggcacaaaagagccaaagtgatgtctttctcccatccctgccccttaggctcccagttctttctggagggagccattgttccttgcatatccttccagagattctacatataaacaaaccaacacacacacacacacacacaaacacacacaaaatttccctccttttacttttgcacaaataggagtatacattttatttgttaactgtctgcctttccctaatagattgaaaattccttaaatgtagaaacttggccttttttttttcttccattgatacatcccctatacctggaacagtacctgacgcatggtaggtgcttaaatttttactgataaatgttgactgataactggaggcaccactggtatagtttttttttttttttttttttttttttttttttgagacagagtctcactctgtcgcccaggctggagtgcagtggcgcaatctcggctcactgcaagctctgcctcccaggttcacgccattctcctgcctcagcctcctgagtagctgggactataggcgcccgccaccacacccggctaatttttttgtatttttagtagagacggcgtttcaccgtgttagccaggatggtcttgatctcctgacctcgtgatccgtctgccttggcctcccaaagtgctgggattacaggcgtgagccaccgtgcccggccaccagtggtatagtattaatggaatcagtgcattggcttacgtatctgattacagctcagtaagtgtgtgaccctcactgagcctcagtctcctcatctgaaaaatgggaatgaccttcatttcacaaggcttgagctaaaaacatgtaaagtgtattgtaaattcctgaatgctctactcatgtaagactaaagtaggccgggcgtggtggctcacacctgtaattgcagcactttgggaggccgaggagggcagatcatgaggtcaagagatcgagaccatcctggctaatatggtaaaaccctgtctctactaaaaatacaaaaattagctgggcgtggtggcgcacatctgtagtcccagctactcaggaggcggaggcaggagaattgcttgaacctgggaggtggaggttgcagtgagctgagatcgcgccactgcattccagccagtctggcgaaagagcaagactctgtctcaaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcagtgagtcctcaggtggggaggtgttgggggagggaggggagaccacctgtttcttatctggcctctccaactccccatcctttttttttttttttttttttttagaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaaacgggggtgaacatgctgggtgacatgagctatttaacctgctgtcaggctcacggaatgagggcattttctgtagataaataagaatgtccccaggctgctgcccctccagggtggtttccatgtgtgctcacatgtggtattgagattgcaaagtgctcttcccatttgattcatgttcacaaaaatagccttccccagcagggtgggtctgcatccctccctcttttacagaggtggaaatgaggtccagagaggcgaagtgacttgcctgtggtcacacagcggtgtctggtggtgccatgctcagagctcctcactctgggtcctgagctcctcccagatctgcctgctgtctggaactgacatctgtagctccttcccagggagatcctgggtctctcaccgccttctgacctccctgtggctgcaggagctactgcttctcggtcagatggtatccccttcccccaagcagtatctcaggataaaaataaaccatcctgttctcttttcctgctgagccaactgagggggagcctagccaggaggagcggcagatggagtgggagcagaggggaggggaggggaggaaggttggaggacaaggaggagaaggaagagcaatgcaaagtgccatgcagaaccccggcacaaaggttcgaggtgaggtttaacccaggggtctcagcctttcccaggaaagaacctgctttggatttccccaacacatcctgctggctggagggtgtggggcgatggggggcaaggggagatgtggagagggcttatcccagtggaggctgtgagggcagctgcgagccaagagaggggcacctggcttggcaggcttcccagaagagcttcaagaaccatttggatacaccaggtggaggcctttggtttagaaagtggagcaaagtggtggtggcggggaaggggaactttgggacctaattcttgtctcttatctagagcctaagagtgagtgttgttcacttctttggtggtatggtggaaagagaccaaagacccacgcctgccacagatcatctgtgtggccttggatgagtcactttcactgcttcacttctcagtttccctatctgacaaatggtgacaatatctgcagcagacgctattgatgcctcctgtgttctcttctaggtcagagcttctcaaatttgagtgtgggtcaggcgcagtggctcacgtctgtaatcccagcactctgggaggcttaggtgggcagataacctaaggtcaggagttcgagaccagcctgaccaacagggcaaaaccccgtctctactaaaaatacaaaaattagccgggcatgatggcgggtgcctgtaatcccagctacttgggaggctgaggcagaagaatcacttgaacccgggaggtggaggttgcagtgagccgagatcatgccactgtactccagcctgggcaacagagtgaaactccatctaaaataacaacaacaacaatagcaacaacaacaacaacaatagcaacaacaacaaaacttgagcgtgtatctggaccacctgcaaggtggtcctctccactattttcagaactggaaggatccttagaactcctagggacccatcatgcatccgggaacaaaagcccagaactgagtaactttcctgaggccacatagaaagctcctggccaatctctgtttagaaccagaacgtgctaacgctgccaagaataaccacctcttcttgttaaagatcgtggggccccacctcctgtgtttctgattctgtgggtctgggatggagatcaagaatttgcattctaagaagtttcccaagtggtattgatgctgccggcccagggtttatacttggggaactactgccttcatatttctttctttctttctttctttcttttgaggtgttgtcttgctatgttgcccaggctggagtgcagtggtgccaccccagctcactgcagcctccatctcccaggttcaagtgactctcctccctcagcctcccaagtacctgggactatgggtgtgcgccaccacgcctagttaattttttgtatttttagtagagacaggggtttcaccatgttgtccaggctggtcttgaactcctcacctcaagtgatcctcccgcctcggcctcccaaagtgctgggattacagggtgagccaccgcgcccagccagcattcatattcctatactgtgtaagcagccagtttctgactgcaagcactggggatcacttgcctcagggcttttccaggtcttgaaaacatgcttggtgcagaggcaggccaggtaagctgtagatgggggagttaattccccgaagtactttcagccagccaaggttgaaagtgggaggataaatactcaagcttccttgcccttgggagggacaaatgtgagctgtgttctacagtgtctccgaggctccctggagggactgagctatggaacctacagtgggcactctgcactgattcccatcctttccctgtctcacatcccctctccaccactggtgcttcccgggttcaactcccaaataaacgacctgcattcatccctagtctcaggatctgcttctgggagaagttccccctgagaatcagcagagcccatgcacaacaatgtgcaattttgtttttcttagcgtccctaatgaagggaagaggtggttattcttggcagcgttagcacattctggttctaaatagagattggccaggagctttctatatggcctcaggaaagttactcagttctgggcttttgttcccggatgcatgatgggtccctaggagttctaaggatccttccagttctgaaaatagcggagaggaccaacctcttcagggtgtagggtcctgcccggtgcgtggacggagggggtggccgtgaggcgcgcatcagccagaaggtggcgccaaggtaacgcccgaagaccctggcggcggcttgggctccctgagtaaagttgggtttgctgactcgccccacacccgcccacacttggaagaggagacctttcttcccttgaccccatcagcctgagcctcctgaagcttctactctgcaacttcatccattcccaggtctcatccttgtcatgaatacttccttccttaacaaataccagctgcggtcccactgtgtgccccatccggagctagggttgtgcacagtgacactgctaagacactgagtgctcactatgtgctaggcacagcgctaaggactttgcatgcattgccttaatctttatgacagccctgcgtaagacgtggtctcttacaatatactttttacagatgagatgcagaagtcaaatgacttgctaaggtctcgagagttagagctggaatttggacctaattaggttgactcaaaagcctgaggtttttgctcattcagtgagtaggaaagtaggcatatgttgcggggtgatgtaaactcatgcccgcaggggctggagaaagggctgggagtcaagtcaggtggcagacgctaggcaaaatggagaggctctgcccatctttgggggacagcctccattggctccttccaatggttgccgagcaggaatgagggttgcagattgtctggaatctggatttttttttttttttgagacagagtctcgctgtgtcgtcgcccaggctggagtgcagtggcatgatctcggctcactgcaagctccgccttccaggttcatgccattctcctgcctcagcctcccgagtagttgggactacaggcgcccaccaccatgcctggttaattttttgtatttttagtggcgatggagtttcgccatgttagccaggttggtctcgatctcctgacctcgtgatctgcccgcctcggcctctgaaagtgctgggattacaggcatgagccaccgtgccaggcctggaatctggatttttatgtgaactcttactatttttaaattccaaaaattggtcaaaaaatccacaaaagtggccgggcattgtgctcacgattgtaatcccagcactttgggaggctgaggcaggcagatcacctgtggtcaggagttcaagaccagcctggccaacatggtgaaaccccatctctgctaaaaatacaacaaaatttgcggtcatggtggtgcgtgcctgtaacccctgctactcaggaagctgaggcaggagaatcgcttgaaccctggaggtggaagttgcagtgagccgagattgcaccactgcagtccagcctgggcaacaagagcgaaactctgtctaaaaaaaaccaaaaaaacaaaaaaacccacaaaagcttggtgagagcatgggaaagcatgtcacagacggctgggattaaaagagactggaaacttccctgtgtcctatccttttgtttttatacgtggggaaacagaggcactgagaaagtccagagctggctcaggcaacatgtcctgggcagcttgtctctctctgtgcccagccaggagttgaagagcccctgggggcttaggatccaccctgtgcaccccaggtaaccagggcctaaggcactgatgctctgggactgagggacttcccttgggagaggcctagttgtgtgtagatgtcctcctcattctatgaacagtcccccgacactcccacccgtgcagccccagccacaggcaggaacacacaccagctctcccacttaagccttcaggccctgcagtcaattcctcgggcagcagaagttattaaagaccctgcccccaaggacttctctcccaccgactgattctggcacagcaaattacaaacccatctgtaggggtggggagatgcagttttaatttgtaaaaacaaagaaagaaaaaaaagaaatctatgctgtggtcctggagttggggaaatggaggaagctcctgagggggctcctcctgggatgagcagtatggttaccgtgggtgctccaggagaagcccagcaaggtcggtgagcagcttgggcccagccagctacagccagtgggcagggggtgagggcgcctctctcttcctatgctcgccctcccttcctgtccctggggctccctgctgactggcacatccctctgggccttggtgcccagctagttctctgcctcccgctcactccagtgctccttcccatcctctgcagcatctgcccgcaccctccttcctgctttctccaatgctttctaactacctcctttcccatctccagctattccgactcaccttgttctcttttgaacaagtgttattattctgcctaattataaaagtcatgctcatgcaccacacccctcatccaagcaataaacaggaccagggaagtaagaccacttgtaaacctcccaccccctgctaaccacaagatatgggtccttctagacttgttttctctgagataaacatttttttttttaaacttgggctattattatatgcattgttttgtaagcagccttctttgcttagcagtgtacggcagacgtctctccatgccaattacatagaaatggacagcatggctttttttttttggtctcactctgtcactcaggctggagtggcacgatcatggctcactgcagcctcaacctcgtgggctcaggtgatcctcccgcctcaggcccctgagtagctgggactacagggatgcaacaccacacctggctaagttttgtgtttctttgtagagatggcatttcgccaggttgcccaggctggtctcaaactcctgggctcaagtgatccacctgccttggcctcccaaagtgctagggttacaggcctgagcaactgcacccagcaacagcatgctttttaattggtgcataggattccactgtagggctggatgctgattcatgaagaggctccatgaagtccctcctggactttcaggcagtgtttctctttccttttcctcatgagtctctccctggtgcctcctccgcttttcctctctctccatctcttcgtctcctacctcccattttctctccacctttcactctcccctcctctctgacttcatccctgagtccccacccttagtttctcctgtcttctcccctccacaccccactctccccagccctacccattccctctgactctctgctccctgcggagggtggggggtccatggtgtttaacaccggctcccacatcagacacgtgccatctcattagcgtgcctgtcccccaaagtgaggcaggcaggagccacagtagcagcgagaggcctaattgaatgtaactaattattcactcccttaaatgggcctgggagggacagaattactcactctgaactggggagacagggaactggccgctggcaaacaaatcctggggcctgtggagagggctctccttggaatactaattagggccgagtgatgggataaaatcagggacagagacgcctctccctgccctcccacctcgtctgggaaattgggggtcaggaggaggaagggactcttgtgtgaatctaattgaaggacccctgggaagtgttaatacggggtgggggcaggggaaatgaaatgctgagcctggggcttgaggaaggcagggggctaatgtttaatatggagagaggcgggagggcacagcagtgcctgagggaaggagctggcagcaaccccagagccaccaagagctgagggaaccccactggctcctgggaggaagcccttctcctcccaagcactaccaagtgccaggccctgtgctaaagaccggtgttccaaatcttcttgaagccctttgtgtgttggctcactccgtatctcagatgagaaaaactgaggctcagagaggggaagcggctccttcatccatgatcaggcagctagaacatgcagggcggggcctcggttccacctggctgcaaagcttctgttcctaacccctagaattacccaggccacatcccagaccaattagataaaatttccatggaggtggcatgtgacggtcatagtctaggcatcagtatttttttttttttttttgagacagtcttgctctgtcacccaggctggagtgcagtggcgcgatcttggttcactgcaacctccacctcctgggttcaaacgattctcctgcctcaatctcctgagtagctgggatgacaggtgcccgccatcacaccaggctaacttttgtatttctagtagagacggggtttcactatgttggccgggctggtcttgaactcctgacctcaagttgatacatctgccttggcctcccaaagtgctgggattgcaggtgtgagccgctgcgcctggccaatcatcagtatatttttttagagcttccctggtgattctgagattcagccagaactgaggacccctggtctggactttatttccctatttgagtcactgcttctatttcacaagtggcatccatccttctactgagccaacctgtcccaaaggacctctaggctctatctagccttatctctgggactggtttccagacagctgggagcacgcaagttggggcaggagggactgtgtggaataggatgagggagggttctaatgtccaggggtggacccagggtagaagacctgaatgcagccccaggagactctgggatgcatcattctgggcagctcctgaaggtcaaaggtgagaagtcaattagggattgtgcagatatgaaaagaaggacaaatcacacgatggagagacgtatagaatggagaggtatgtgtgtgtgcatgcgtgcgtgcacgtgtagtaagggagtggttggtgtgggtgggtatagtaatcgtgattcttgataccatttatgtgccaggtgcttttcccatattatctcatttggtcctgacaacagtcctttgaaggtgtatggtcatccttgcagctgagcaaggtgcagctcagaaaggttgagtaagcgtcccaaggccacacgcagaaccagtattcaatatctggctcccagtttcaaatcccatgctcctttctcctactctgccttgattgtgctattgcacttgtgatctcttctctagcaggtgttggtgtgtgtgcatgctggttaggtgtgcatgatgtgcgtgtgcttgtgtgtgtgttgctccctccttttgggagggacaaaacttccattctgcccagcacaatgcctcctgctgactagtgagagggaagaggaggggcacccactcctgcttcttgcccctgttccccagtgccactcagctggtgactgcctctcctgtggctggggctgaggaggggcggggcaaggcgggttatcctcccagccaagtgacaaatagccttatttgtaacaaaggtggagagacaacctatttctagggtggggaaattctctctttttcaggctttcaagctgccctcctgccaccccatcccctgccccagtgaaggtggcagggagagatgggcctgtcacactcattccccttccgttccgccacctcaagtgcaggggacttcatgggagcttcatagaggggcagcaaatttatgagcccaacaccgattccccgatcacctcgctggccaatccatctttctggagccagagatgaaatgaaattattgtgaaataaatccatacagatgatcgagggactggcagcagggggacagcaaggggtgggagccaggagctggggctcaggtgggagggctattgccactccccttggctgagacccagagaggggacttcactggctttccttcctttgatggggtggggctgcgttctgcttatgccaccaactctctatggagcctcttgcccaataggatccttatctaaggggctgaatgaaagaccctccagcttgtgatgggtcctgtgtcactcatgcttccaaactcccagggtcagagagcaaggagggagtgggaggggttgcattcagggtgaggtgggagtgaagacagagtcagagtcagggccaagggcctgggtgatgcttcccatatttaattacccgccgtggaggccccctgctgtgccaggtgttcgtgcctaagttttgggaatgaagggagacccaagggaaggcaccagtgttggggttactcaggcagcttggggccacagctgtttaccaggaggtttggaagtagttcaatattttaacaacctctgtagtaggacttcatattccagctgagttccgatcttggagcagggcgagggttggggctgcttggtgccctctccctcctctttgcccagcagtgtctgggatattccccacaaagatcctgcaggatggctgtgtctcaggctggtgcatcaggggctggcctcagagccaaagggtccacagtggacttgccaagcccagagtgccagagctttcctgcctcccctcccactttagccagctctcagggggccccccaccaccctgagcactgagctggaattggaggcagccagccggctgggatgtgatcattcggcctcctgagcaaggccagccctggccacagggaaacaatgaggtcccttgagtagtcaagggtctgctggggccactgggcaggacaggccctccctagcctgccctggtcttgctctgggaccttgaccctctccccttctgaggaaggagtacagtggctttgggggatgatgaaggccagacagccagaccctcagcacctattgatgttgctggctgggtgggtgtgtgtctgagtgcagccccgggctcacattaggtggggcgggggtggaagccagacatagactgctctggaaatgagatttgcctcgttatctgtgcttgctcagaccgagggccttgggcattagccagcccatccaaggagttaagaagcaggaggaggggcagagagccgaaatccaggctccagtggatagagcccctgctggaatgtgtgtgtatgtgtgtccctcggtggtttggatttgtggggttttgtctacaaaagtgtgtgtgttttcctggttagtgtggatgtcctttaaaagaatgtgtgtatagcactttgcctcctgctcatggtggttgctgtttctctttagtgtgtgtgtgtgtgttgctggaattaacacaagtatgtctgtttctggactgcacctgtgtgtgcacacccacaggctcctgttggttttgtttgtacatgccctgttcgcatcccagcccactcagaaggctgcaggcccagacacagcctaatggacagagccaggtgggcagggcaggctggctggcctgcacccagggggcggtgggtggatctgggcatcttccagaggcaccggcctggcagggaacaaaggggcaatcagtagagaggccactagagcacagctgattgaggaagaggaattaactaggagccccatggggctctgcagggggcgggggcggtggcccctggcattctgattaggagggggagcaggtgcagctgggcttacctgagccacaggaaggagttggagggggcagaggggaaagcctaggatgggatgaagtagagcagagctgggagctgaggacctggaccaatgactttgagggagaggagcaaggggtcctgggtgagaaggtcacagagtgtactgagcagatattgtcatcctaaatgggatccttgtcacctgtcatcctaagtggatcacactcccacttatccagagcttgctgtgggcctggcaatgggctaaacatctgccatgtaatcctcacagcacagaagccagttccatcatcagtcaggctcacacatgaggatgtggatgcccagagaggtaaggcaacttgctggaggacacacagctatgaatccaggtcggctcggctttagggtcctcattttaacctctatgccaccttgccactccccaggcctctgctgcattgccagtggggagatgctacaggaagacagactgtggcacagaaaaagagggatgtacaaatccacctgaccaaaaaagcagcctgatcctggagggggtgaaatgcctgacactggaggtatgcaaggaatagctcactaacaaaggggttccttgctggataggtggttggattccattctctccatcattgtaatatggattgagtcagagtccccgggtttgaatcccagctccaccatttattcactgtgtgatattgggcaacttgctagacctctctgtgtttcagttttctcatctgaaaaatggaggagtgtgaggatggagggtcagagagagctgggggaagaggtgggacttgggatgaacagaaagcaaggtggcaatgcaggtgttaggctctggggcttgaggggttgagtggggttcaggtgaccttaggttcagcttcctctgctctagcccagacctcacatctctcactggggccattgcttcagcctccatcctgcttttcgtgcccagcctctcctcctccggcccattctctgtcctcttcaatttgaccatgtcactcccctcatctgtagcctttaatgactcctctccccctataaaagtggttttcaaagtgtgtcaggagaaccccctgcgggttgggggataaccttaggtgacacatgatccaggtctcctgggagactttgcacagttctcttttgatcccaaggaggacaccccagtttggtgctggtttgtctttcatatcctttgctgtaggaagatcaggtcagactcggccaccagcaaacaactgagtctagttagaactcaataacgctgatttgttctaagctttgatttctacaactgtttccttctcaaacaccttctcctctgggctccccaatgctgcattttctcatttgccaccctgcttcactgcttgctcccggcaggtctcctgttttgctttttctgctgcggctggtcctctcaacgcaagtgtactatcaggctctgcctcattcctattcttgtctggagctccatctagtcccagagcattaaccactaccactgattctcaaatgtaactctcgacccagatcaatttccagctgccttcctgatatttctatttggatgtccaataggtatttctaatctacaagtcctaaacggagcctgtgctacccacgcctctgcctctccccttgcctgccttgcttcagtaggtggtcacacatctaggagttatccttgactcctctctcttctttgccttccccatccaatccattagccatgcctgtcaactttacctgcaaaacatattctggaatagccaattcccttcatgtcctcatgccctggtccgagccagcatcacccctcacctgcaggctgcagcagcctctgggctgatcatgccgctctcaacttgcatccctccaaacctaccacacggcagctggaggatcttttaaaagcattaatcagattacatcactcaactgcttaaaactctcaaagggcatccccttgtgcttacaacaaatccaagccctttgctctggtttataaggtgctgtgtgactggggtttttttctgtcagtttctcttactccatccatatccctctctcccttgctcactctgctctcgtcacattgccctgcctttgcccttgaacctactgagctcggtcccactgtgttccctctgcccagaacttctctcccttgatcttctcttcctttagctatctgctggggggggggtcacttcctccgagaggccttccctgagtactcaacaataaagccactccagacaccactgcatccctctcttcttgctttttgctgagcatgacaggtttttttttttgctttcctccatataattacaaactccacataagaaggaatgttacctgtcttgttcattgctgtattttcagtgccaagaatggtacctgaatcatagaagatgattattatttgctgattgaattaatgagttgtattttttacagttacctttgatgtatgacaggtgtcacttttttttccattttagatggtgacataggtttccttttaagaataaagcaaaaaaaaattctgataagagacttgaatatataaggaactcttataactcaacaataaaaagacaaatacaatgaaaacatgagcagagaatttgaacagacatttctccaaagaagacatacaaattgccaataagcacatgaaaagatgctcaacat

SEQ ID NO: 301 - DNA, 1729 bp, Homo sapiens
  cDNA CD40-001
ggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 302 - DNA, 1623 bp, Homo sapiens
  cDNA CD40-002
tggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 303 - DNA, 1522 bp, Homo sapiens
  cDNA CD40-201
ggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattg

SEQ ID NO: 304 - DNA, 822 bp, Homo sapiens
  cDNA CD40-006
ttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgaggg

SEQ ID NO: 305 - DNA, 1733 bp, Homo sapiens
  cDNA CD40-003
gtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtgggctgggactagaatgaggtgagcaaggcacttgccctcgggcgcaatatttaagaaggtgccataaaagtgtagtaatcaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 306 - DNA, 771 bp, Homo sapiens
  cDNA CD40-005
ctggggctgcttgctgaccgcttttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggc

SEQ ID NO: 307 - DNA, 710 bp, Homo sapiens
  cDNA CD40-004
cagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaa

SEQ ID NO: 308 - DNA, 27272 bp, Homo sapiens
  Coding Sequence of the TNFRSF9 Gene
cctgtgaacatcatagttttgtgttttattagatagtcttttaaataaaaacgttgataaagatcactctccaagtcctaccacacacagggcacatgtaacctgccctagctgcggtgggcacctctcacccacagatggaaacatcttcctgtgggggaagatgcccactttatagtcatccgcccctcacatcaaaactttccgtcagagtgatatcttccactaaagaaaaaaaattaaaactttcttctgaaaaaaacctgagcttgtttttagcatttagaaaatgatttataatttgtgtatccctaaatgtgctaatttatttttaatcatagaaatttacatttatttctattaaacctaattatggaactttctaaattaaacccagaaggggatcattttattctgtctcaatgttccttccttattaattgtcatttagggggagcaatgactcacatgccaagttcctgtgtttttcatttatagcttttgcacatgataccagaataggctatgataaaaatatcacagtctgtatcataaacatagcctcctttcttcacagaataaactgtggattttcggtgtgtaacctaggacacatgagagcctcgctccattatcttggataccccaaccctgtggggcatgaccagtctctttctgtttgtggatagtcagcagtaggtaattaaacaccatgtgtccaaagccaagaggagaaatcactttagaacttacagcatcatgattcagaaagacaaaaatattcgcacctagctttgttcctgaaatggcaccagtatacttcctaagctttgctttgcctactatttggcaagaattgtacagccaataattgttctcttattcttattggaacaccagatgactcaattctgtaaaattatcaactctccctaaattgacctgtagatttaatgaaattccaatccaaatcttttcaaattcagcttctaaaatttatattgaataataaagaaccaagaataaccaagacatctcttttcttttttttcctgagacagagtttcgctctgtcacccaggctggagtgcaatggtacgatctcggctcactgcaacctccgccccccgggttcaagcaattctccggcctcagcctcccaaatagctgggattacaggcacatgccaccatgcctgactaatttttgtattttttagtagagatggggtttcaccatgttggccaggctgtctcaaaactcctgacctcaggtgatccatccgcgtcggcctcccaaagtgctgggattacaggcgtgagccaccgtgcctgacctagctaagacacttctgaagtagaaaaagaaggtggagggagatgtcctaccggatatcgagagctgttacaaagctattgtaataaacacagtgtgatactggcacaggatagacaaattgacaatggaacagaacagggagcccagaagcagacccatggccctatggaaacttgatggatggtaggtgagattgcagacccgcaggagaaagacgacgtattgaatacatggcgcagggaccagtggttacctacatgcaagacatggaattggatcactacctcccaacaggcacaaaagccagttcctgatacattagacttcaagatgaaagacaaaacttaaaacttttggaataaaatgtgggcaaacctctttatagtattgggcagaaaaggatttctttagccaggcaagaaaaaatgttaaccatatgagaaaacagttataaatttaaccaaatcaaatgaagaactttttgcttattaccagaaagacaaagaaagacaccattaattagagaaaaacaggaggggcgcggtggctcatgtctgcaattccagcactttggaaggctgaggtgggaggatcacttgagctcaggagttcaagaccagcctgggcaacataatgaaacctcagaaacctcacctctgctaaaaataaaaataaaaaagaattttataaaaaattttaaaaagggaaaaataaattacaaaggatatatatatatatatatatagatatagatagatagatagatagataggcagaatttcactcttgtcacccagtctggagtgcaatggcacaatcttggctcgctgcaacctctgcctcctgggttcaagcgattcttctgccacagcctctggagcagctggggttacaggcacccgccaccatacccagctaagttttgtacatgtttagtagagatggggtttcactgtgttggccaggctgatcttgaactcttgacctcagatgatccacccacctcagccccgcaaagtgctgggattacaggtgtgagctaccgtgcctggccacaaagaagatattttttaacacatataactgaccaaagattattatctagaatacataaagaccttttaggaatcaggacaaacaaccacatttgggtttgtttgtttctgagaaaaggtttttctctgttgcccaggctgaagtgtagtgatgcggtcccagctcactgcaacctctgcctcccaggctcaaagcgaacctactgagtagctgggacttcaggtgcacaccaccacacccggctaatttttgtattttttgtaaagacagggtttcgccatgttgccaaggctggtctcgaactcctgggctcaagcgatctgcccaccttggcctcccaaagagctgggactacaggcatgagccactgcacccggccccaagtttttttgcaaatgggcaaaaaagcatgagcaagcattttatttaaaaaaataaacacaaatggtatataaatatttgacaaggtgctcatcagtaaccaagcaaatgcaaactaagaccacagtgagatctcattctatacccactggcttggcaaaattaagggcacctgatagtaccagagggtagcaaggatgtggatcaatgggatacttacatgacacttatatgactgacgggagtacattagaacagccactttgaaaagcaatttggtactgcagtagactattgttcagaaatatcttctcctcacccctatttacagaatatacttttctgccctattgatgcctggcttggctgcaggatttgctctaaaggttatagtagaaccaactaaataggagcagaagtgacagatacccatttgccatgcgatggccaatgttccaaatagaagctgctccctccacctaaatcccagagtaaaataacatgggacagaggcacgcaagcttgcaataggcatgtcatacaaaagtgtaagaaatggccaggcatggtggctcatgcctgtaatcccagcactttgggaggcagaggtgggcagatcacctgaggtcaggagtttgagaccagcctggacaacatggtgaaaccccgtctctactaaaaatataaaaattagccaggcgtggtggcacatacctgtagtcccagctacttaggaggctgaggcagggagatcacttgaaactgggaggcggtgatccaagattgtaccactgtactccagcctgggagacagagtgagacactgtctcaaaaaaaaataaaatgaataaaatttaaaaagctatccttagatcataagccaaacaatggcaggcatgccaggtttgcacctgtaatcccagctacttgggagactgaggcgggtggatcacttgagcccaggagtttaaggctaaagtgtgctatgattgtgcctgtgaatagccactccattccagcctgggcaacagagcaagactgtctcaagcaaaccaacagacaaacaaaggcaaatggtgcaccaggtttggccatgggagtttggcggcccccactctagtgctgtggtaggacaatgagctcacaggtgttaattttctcactgtacttcatacctatcatatgcagttcatttattggctttggtataaaatattatgttaaaagttaagaatttttagaatgtaacctggcttaaaagggagcaggacaaaggcagaaggtgtgaggatggagaagaccataggatatacagacacttgaactctttccaaaacttcctccaggcctgaggttttttgtccttgaccctaaactcaggcactctgctcatactcccccctgacggtggagcatgtcgtgttacatgacagaacccacggaaactttagtcgggtacttactgcacctcgtggcttattgtcatatgtcatattagcaccaaaaaacaaacctgcattgattttgattataattatagttggaccactggactatgtaattgaatttaaactataattttctttggatttcaaaaaaactagctcaaacctgttaagtggtatctagaaaatgcttttttttttttttttttatcaccagctctgtcctcatctgtctgttctgttaaaagtggtgcattattttggccgggcctggcagttcatgtctgtaatcccagcactttgggaggccaaagtgaacctaggagtttgagaccagcctgtacaacatggtgaaatgccatctttaccaaacaaaaaacaaaaaagttagtcaggtgtggtggcccttccttgtagttccagctactcaggagactgaggcaggaggatcacttgagctcccagaggtcaaggctgcagagagccatggtggtgccactgcactccagcctgggtgacagagtgagaccctgtcaaaaaaaaaaaaaaagtggtgcatttttaaaggccaactcattggcatttagaaaagaacgtgtgttgggggaatcctgggtattatgtaggatggtgttcttgcttttgaaagctgtgatagcggatgactcatatttccttgcttcttttcaagaaagtcccaacagccctattgacttccatttcacagttcacatcctccttcttcttcttctggaaatcggcagctacagccatcttcctcttgagtagtttgtactggtctcataaatgctaaaaaaaaaattttaagatacgtatattttgttgtctatttgaatcatttaacacttattttccataaattatagctgcagaacatctctaagcagcaaacattctcccctttaattttaacaaactcagccaggcgtggtggctcatgcctgtaaccccagcactttggaaggccgaggtgggcagatcacttgaggtcaggagttcaagaccagcgtggccaacatagcaaaaccccatccctactaaaaatacaaaaattagccgggcgtggtggcaggtgcctgtaatcccagctactcaggaggctgaggcaggacaattgcttgaacccaggagacagagattgcagtgacttgagatggcgccattgcactccagcctgggtgacaacagcgaaactctgtctcaaaaaacaaaacaaaacaaaacaaaacaaaacaaaacaaaacaaaaacaggccgggcgcagtggctcatgcctgtaatcccagcactttgggaggctgaggccggtggatcacaaggtcaggagttcaagaccagcctggccaagatggtgaaaccccgtctctactaaaaataccaaaaaaattagctgggcgtggtggtgggcgcctgtaatcccagctactcgggaggctgaggcagagaatcgcctgaacctgggaggtggaggttgcagtgagctgagattgcgccactgcactccagcctgggtgacagagtgagactccatctaaaaaaaattataataataatagtaataataattttaacaaactcatccacaagagaggtaacagcaaggatgaacttcctctagagattatttgaaatttgtttcctcttaccaaatatttgtattggtctttaagaactattttctttattttctacattagctaaaaaagcatgaatcttaagcatgaatcactaaaccataaaatattagccatatcccaatcatagctctagtttcaattcagcagcacttattttcgtcttgagggttactgagattcgagatccgatggtttccttggaatgcagtgttatgactccaggattgtgaaggtatccccactgcttccatctgttaggaaccaagaaccgatctgtgcgtgagctgccaggctttcttttacatgttagtgaagtatttgtgttactgctccgcaaatttcaatcctaagcagatatttatttacagactggcaaggcaaaaagtcctaccccgatttcatatgcttgttgctataaaaaataaccacaccatctcctagaacttatgaaaaactggcaagatgttcagaaataccaacgggatgtcttttgaaattgttcccaggttgaatttcaaaatggagatctcttctggaaagattgagatgtcatgttttccgtatttgtcctgctgagtactgctgaaaacctctcagaaaggcagagagaggaaggccaattgggtcaggatctccagacccaagaaacaacatggcaatgggtttctttctgcctcatttccctctgactgggaactagagaagcagcactctaaaaatgccaatagcgtggacaaaacaaagcaaaaaccaagaagaggccaggcgtggtgactcacatctgtaatcccagcactttgggaagccaaagcaagcagatcatctgaggtcaggatttcgagaccagcctggccaacatggcgaaaccctgtctctactaaaaacacaaaaattagctgggcatggtggcgctcacctgtaatcttagctattcgggagtctgaggcaggacaatggcttaaacccaggaggcagaggttgcagagagctgagattacaccactgcactccagcctgggcaacagagcaagactccatctcaaaaaaacacataaaaaactaagaggagcttgtactctctagttatgagaccaggaaaggggcagcatagcaagactacaaacttcttttttttttcttttttttttttgagatggagtctcactctgttgcccaggctggagtgcaatggcgtgatctcagctcactgcaacctccgcctcttgggttcaagcggttctcttgcctcagtctcctgagtagctgggactacaggtgcccgccaccaggcccggctaatttttgtgtttttagtagagatggggtttcaccatattggccaggctggtctcaaactcctgaccttatgatccgcccatctgggcctcccaaagtgctgggattacaggcgtgagccaccacacctggtccaaaaacttctagacaataaccactcaattctaacaaaacaccacaaaaaacaccgtggctccgcctgcaagcccaccaggaaggactgagtagagagcctggacttccaccctcacggctgattaaggctcatctccccctccctcctggggtagtgtcagaggaggcctagtgggagctagaactcccacgtgtctagcagtaaaaaggagaccctcaccctccaggaggtatagcatagaacccaaacttcctccacccctgcctggccgtaacgagctgcccatcctccttccttccctagagtgatgtcagaggaaccctgagaaaatacaagatctaaattagatccagaaactgggtgtgggggctcacgcctgtaatcccaatactatgggggccaaggcaggaggatcgcttgagtccaggagttctagaccagcttgggtaacagagcaagaccctgtctctacaaaacatttaaaaattagccaggggtggtggcacatgactgtagtctcagctactctggaggctgaggtgggaggatcacttgagcccaggaagttgaggctgcattgaggcgtgatcatgccactgcactcccgcctgggtaatagagcaagcaagaccctgacttctaaaaaattttttttttacttaggcctaaatctaacaaaacacatacagaacttgtatagtgaaaactacaaaatgctggtgaaataaattttaaaatgtataaatgaagagacatactatgttcctgcattagaatacagtcatacagcgtacaacaacgttttggtcaaaaacagactgcatatatgatcgtggtcccataagattatagtggagctgaaaagttcctattgcctcgtgatgtccaaccatcataacattgcagcacagctcattgctcacgtttgtggtgatactgatgtaaaaaacctactgagctgccagttgtgtaaagtgtagcatatgcaattatgtacagcacataatccttgacaatgacaataaatgactatgttagtagtttatggacttactataccatactttttatagttatttcatagtatattccatatatatatatatatatatatatatatatatatatatataaccagttaaggccgggtgttgtggctcacacctgtaatcccagcactttgggaggccaaggcaggtggattgcctgagctcaggagtttgagactagcctgggcaatttggtgaaaccctgtctctactaaagtacaaaaaattagccaggcatggcggcatgcacctgtaatcccagctactcgggaggctgagacaggagaatcccttgaacccgggaggcagaggttgcagggagccgagaccgccccattgcactccagcctgggcaacagagcaagactcctctcaaacaaaaaacaaacaaacaaacaaacaaacaaaaaccagttaattgtaaaacagcctcaggcaggtcctttgggaggtattccagaagaagacattgttctcataggagatgacagctacatgcatgtttttgccccaaagatcttccagtgggacaagatgtggaggtggcagacaccaactctgtgtgggtctaggctaataagtgtgttcgtgtcttagtttttcacaaaaaaagtttaaaaagtaaaaagcaatttaaaaacttttaaatagataaaagcttatagaataaggaaataaagagaaaatatttttgtacagctgtacaatgtgcttgtgttttaagctaagagttattacaaaagagtcaaaaagttaaaaaaaattttttttaagtttataggctgggtgcggtggctcatgcctgtaatcccagcactttgggaggccgaggtgggcagattaccggagctcaggagttcgagaccagcctagccaacatggtgaaaccccatctctaatacaaaaattagccaggcgtggtggcagctgcctgtagtcccagctacttggggggctgaggcaggagaatcacttgaacctgggaggtgcaggctgcagtgagccaagatctcgccactgcattccagcctgggcagcaagaccctgcctcaaaaaaaaaaaaattaaagtttatgaagtaaaaagtcacagtaagctaaggttaatttattattgaagaaagagaacattttaaataaatttaggttagcttaagtgtacagtgtttataagactacagtgatatacagcagaggtccccaacctttttggcaagagggaccagttttgtggaagacaatttttccacggactgggtgggtggggggatggtttcaggatgattcaagcacattacatttattgtgcactttatttctattattattactttgtaatatataatgaaataattatacaactccctgtaatgtagaatcagtgggagccctgagcttgttttcctacaactagacagtcccatctgggggtgatggggaacagtgacagatcatcaggtactggattctcataaggagcgtgcaacctcgatccctcgtatgcgcagttcacaataggattcatgctcctatgagaatctaatgccgctgctgatctgatgggagatggagataaggcggtaatgcaagtcatggggaggggctataaatacagaggaagcttcacgtgcttgcccaccactctcctcctgctgggtggcctggtttctaatggcgtctcactctgttgcccagccaggagtgcagtgatgcgatctcggctcactgcaacctctgcctgtcaggttcaagggattctcccacctcagcctcccaagtggctggaattacaggcatgcgccaccacacccggctaatttttgtatttttagtagaaacagggtttcaccatgttggccaggctagtctcgaactcctgacctcaggtgatctgcccaccttggtctcccaaagtgttgggattacagacatgagccactgcgcctggcaaagatcatattattttcacggtacctcttctatgtttagatatgtttagctacacaaataccattatgttacagttgcctatggtattcggtacagtcacatgcctgacaggtttgtagtataggagggataggctataccatccagcctaggtgtatagtaggctgtaccatctaggtttgcataagtgccctctatgatgttcacacaacaacgaaatcacttaacaacacatttctcagaactacccctgtcattaagtgatatgtgactgtacttcacatagtaaagatgtcaatttgcccgaaactgatatgcagatttaacacaattgttatcagaatcccagccggctttttgtagatatagatattatcctaaaatgtatgtggaaatgcaaaggaactagaatagataaaacaattttgaaatgaaataataaagtgggagagactaccaccctctacccaatttcagtatttatgtataactacagtaatcaaggctgtgtggtattggcagaagaagaaacacatggatcaatggaacagaagagggaaaccagatagccccacgtaattgcagccaactgactttgacaaaggtacaatgaaggatgactaatgttttccactagtggtgctagagcaattggacgtccatagtccaacaacaaaaacaacaacaaaaaacttggctaaaacctctcacaccttatacgaaaaatttaaaacgaatcaagcatgggcacagtggctcacacctgtaatcccagcactttgggaggccaaggcaggaggattgtttaaggccaggagttcaagaccagcctgagcaacatggtgagactctgtctcaaaataaaaaaaaaaattacccaggcatgcagagagccaaagcccgtgagacgtgaccaactcaacattccactggaggctatatgatcaaacagcaaagtgttcatcacgaatgcaagatgtgagcaaactcacactgccctgccaccaaaaagtttgctgagggacgctactccctggctccttgaagttatctattgagaaatctagcacctattgttcaaaggatgcagtctcacaagcctgctgtgaaccaaacaccaaacggctaactgacaattacccgacaatcatccccgctttctcactatctcttttgcctaataaatacggagggctgtgtaaagctcagggcccttgtccactagaggcaaggtgccccctgaccccttcttccaaatatactcttttgtctcgtcttttattcccgcttttgcccccctttgttcagtccaataggtccacagcaagtgctggcacactcctgtagtcccagctacttgggaggccaaggagggaggatcacttgagcccaggaggtggaggctgcagtaagccatgatcacaccactgcactccagcctgggtgacaaagcagagaccctgtctcagaaaaaaaaaatcaagatttaaatatgaaatagaaaactgtaaaagttataagagatagaggaaaaaaaaaaaccctaaatctttgagacccaggactcagtgaagaattcttagacatgactccataaatgaaaaaatccataaactggacttcagcaaaattaaatagcttttctctgtggaagagcctgagaagaggatgaaaaggcaagctactgactgggagaaaatatttataaaccatatatatgccaaaggactcctatctgggaaatacgaagaactcttgaatctcaacagtaaaacaaacaaataatccaactagaaaataggtgaaagacctgaacaacacttcactgaagaagatataaagatggaaaataagcacatgaaaagatgtccacccataagggaagtgcaaattaaagccccaatgagatgtcactacatacctattagaacagctgaaataaaaattgtggcaatgcaaaatgcaagcaaggatgcagagaaactccgatgagaatgtaaaatgatacacttcctctggaaaatagttcgacaacttcttaaaaactaaacaagcaccaaacatatagcccagcaattgcactcctgagcatttatcatagagatacaaaaatacatgtccacacaaaacctgtacataattattcctcgcagctttatatgtaatagtcaaaacaggaagcaaacaaaatatcttttaatgggtgcatggtaaaacaaactgtggcacaagcatatcgtggaatactattcagcaaggaaaaagaattaaccattgaaacacacagcaacttggatggatatcaagggcattgtgctgagtgaaaaagcaaaatcttaaaaaaagttcacgtttgtgaaagttgtcagaatcaaaatggagtaacttgtgtcaaaaccctgacaaatgggccgggcatggtggctcatgcctgtaatcccagcactttgggagactgaggcaggcagatcacatgaggccaggagttcaagaccagcctggccaacgtggcaaaaccccgtctctactatagccgggcatggtggcagctgcctgtaatcccagctactcaggaggctgaggcacgaaaatcgctggaacccaggaggcggaggttgcagcgagtggagatcacgccactgcactccagcctgaatgacacagggagatcctgtctcaaaaacaaacaacaacaataacaacaaaaaaccaaaaaacaaacaaacaaacaaaaaccctgacaaatggagccagggaaggccgtgaagggggtttcttatgcatgcatgcctgataaaaacaactatcacaaaagatggcagaaaccacaaccttgcaccaaggctactgtatcttaacaaaaaaatacttctgccggtattgatctttgtagcaaaggataattgtttcaaaataacttacataaccctcctcagtttttcttttttttctttttcctttttttttttttttttttttgagacagagtcttgctctgtcgcccaggctggagtgaagtgcaggatgcgatatcagctcactgcaacctccgcctcccaggttcaagtaattcttgtgcctcagcctcccaagtatctgggattacaggcacgtgccaccatgcagggctaactttttgtatttttagtagagatggggtttcaccatgttggccaggctggtctcgaactcctgacctcaggtgatccatccgcctcagcctcccaaagcgctgggattataggcatgagccactgtgccccgcccctcattttttcttttaaaaactcgcatcacctttacatccctgaatacacccaccgtattcccactgcaatgctactcctgaaaaaatataatcttttagagaggctctctctatctatgatttagcttgacacataccatatgattctatttataccatattccttaaataacaaaagtatagagatgaaagacagataagtggttgccaggggatggtggggagaggtagaggacctaactagaaaggaatagtggaaggagatctctgtggtgatggatagttctgattttattgtgctggttgttatacaactccacatgtgtgataaagggacaaacaactacacacgcacactgtgccaatgtcaatttcctgctttgccattgtactggagaatggaacccagaaaccgcatgagagatgttcctgtcttggcaaattcctgtgaatctataattacgtcaaaattgaaagttcttttgaacgacctaaaacctttttttttttttttttttgagacggagtttcgcttttgttgcccaggctggagtgcaatggcacgatctcagttcactgcaacctccacctcccgggttcaagcgattctcctgtctcagcctcctgagtagctgggattacaggcatgcaccaccacgcctggctaattttttgtatttttagtagagacggggtttcaccatggccaggctggtgttgaactcctaacctcaggtgatctgcccgcctcagccccccagaatgctaggattacaggcgtgagccacagcgcccagccagaaggaaggcttccctgaccaggaatcgaacccgggtcgtgatggcgagcgcggaatcctaaccactagactaccagggagtgtcctaaaaacttttaaaaaatggattacagttccattgaaactcactaattactcataaatacttttgaaaagcattttataacgaactttgttgcagtctggggtgtggatggaactttgttgcagagatactcctttaaatcaggattaagtccagcactttgggaaaccgaggtgggaggatcgcttgagcccaggagtttaagactggcctggacaacaccgtgaatcccagtctctacaaaaacactaaaaatcaattaaaaattagctgagtgtggtggtatgcacctatagtcccagctatttagtaggctgaggcaggaggattgctcgagctctggagttcgaggctacagtgagctgtgatcgcaccattgcacttcagcctgggtgacacagtgaaactctgtctcaaaaaaacaaaagacaaaactgaaatcaggtttaagtgagaacgcagaggtttaaactggaggtgtagacctcaaaaaaagaatgaaagagcaaaccacagaataggaaaagatatttgcagctcatgaacagcagactaaaaacttcctatacgttagtaagaaaaggacagacaatcctatgagaaaatactcaaaagacttgatcaggcccttcactaaagaggaaatccaaatagccaaaataacatgaaaaggcgtctaacctcactagcaaccaggaagtgtaagttaaaaccacaatgagatacaactatccacccaccatatcgataaaaataatctgatgataccaagagttatcaggggatgtggagtaacaggaaactcattaccgccaggggagtgtaaatggggtccaatcatttaggaaaacagtttggcatattcacgaccaagatacacatgttccttgtagctcagcaacgttatttctaggttaaaaaacaaaaccaagccagaaacacgtgtttacgtgtgctgagatacacggacaaaaatattcaaacgtcattacatgtaataaccccaagctggaaatgatcccgctgtccatcagtactagaataggtgaacaatgatgtcatcattcaacaagagtgtgcaacagtggaaatcaactaaagatgaactcaacatggatgaatcttcatgatacaacgttgaaagaagaagcaagatacagaaaacagtgtgattctatttgtatgaagttcacaagcagcccaataaaactgtgttattaggtagcaaaactacagcaaaaggaagttaataccatacaagtctagatgtggttagcagtagtgggcaaagagggctgtgatctagaaagggcatgccaagggcttcgggaatgagttatgttccacttctttaccctggtagagttatttgaatgtttgtttacaacaatttgttaaactttacatttatgcatttttctgtataggtcacaatgtataaaagttctatattgctttaaaaagagcctttaaatacattagcataatttattagataagactttactggctgagcgcagtggctcacgcctgtaatcccaacactttgggaggctgaggcgggcggatcacctgaggttgggagttcaagaccagcctggccaacatggagaaaccccgtctctactaaaaatgcaaaattagctgggtgtggtggcgcatgcctgtaatgcctcgggagcctgaggcaggagaatcgcttgaacccggaaggaggaggttgcggtaagccgggatcacgccattgcactccagcctgggcaacaagagtgaaactctgtctcaaaaaagaaaaaaaaagactttactaatgctgttcctgcatatatatttttaacaatctccaaataggcacattctggtcttacatggtgctttgggttaaaattttgctctcaaaaagctccttttattatatccctcttattaagtcttattaagcctgttatgtctcatcctaatgtccatgaagacaaaaaacagattgccttccatctatatactttttcaaataaatatcaatggcttttgtctagtggatgctgactcagtgccaggcacttgctgagtaccttacagaaataattgttgaacaagtgaatgaatgaaattcattattgaaatttttcatgtaatccatactggtgctgtaataattcatttgttaaacccccttcaagctccctctttgttctccttgccttcctcaaatatgggtctaaactcattttaagccagtttatcaaccagagggacatagagggaacatggttttctgattcttctttgccagtgtcctccacacgcacacacacacatacacacacgcacgcacgcgcacacacacacgcacacacacacagacacgcacacacacacatacacacacacacacacatacacatacatgcaataatccaaggctgcagcatatttaaatctgtcatttttctagaaccgaggtgtgctcttctatatgcaagctttctccacctcagcactattgacatttggggcagcatcattctttgctgggaggctgtcccgtgcacggtaggagttgagcagcattgctgacctctactcactagatgcaatagcccctaatcaccaccatcaccaccgagcggtgaacactgcaactgtctccagacactgcaaatattcccagggacgaaattgcccctgcgtgatagccacggggctatatgaacctcatttctagaattttttttaaaatcatattttcctttctattataaaaagccttgccttgccagagctgtaatatgattatgttaatcttacgttgtttgaatatatacaggagtttctttctgccccgtttaacaacagagaaacggagcgtgaggaagaacagcaggaagagcaacgcagtcgacgtcagcgcaagaaagaaggagatgatctgcggagagtgtcctgcaaaacacagcaaaaggagaaacgcatgcagaaatgtgttgacactcatacacccatgtatatatttacattggtaaatttctaagcatgagaagaatcacagccttgggcatctccaacctgctaatggagtaaacttagaaaacttttaaagaggccagacatggtggctcacgcctgtaatcccaacactttggaaggccgaggcaggaggatcacttagagtcaggagttcaagaccagcctggccaacatagtggtggcaggaacttgtaatcccagctacttggcaggatgaggcaggagaatggcttgaacccgggaggcggaggttgcagtgagctaagatggtgccactgcactccaacctgggcaacagagtgagactccatctcaaaaaaaagaaaagaaagaaaagaaaaagagaaacttaatggcagggagcggtggctcacacctgtaatcctagcactttgggaggccaaggtgggcagatcacctgaggtcaagagtttgaaaccagcctggccaacatggagaaactccatctctactaaaaatacaaaaattagctgggtgccgtggtgggcgcctgtaatcccagctactcaggaggctgagtcaggagaatcgcttgaacctgggaggtagaggttgcagtgagccgagattgcgccattgcactccagcctgggtgacagagagagactctgtccacccccccaaaaaaataaaagaaacttaataattgagcagtttatcctttctagcacatagaaaatatgggacctggggaccaggcgtggcggcttatgcctgtaatcccaacactttgggagcccaaggcaggaggattgcttgagcccaagagtttgagagcagcctgagcaacatagcaagaccccgactctgccaaaaaaataaaaaattagccaggtgtagtggtgagtgcctatagtcccagctactggggaggctgaggtgggaggattggttgagcacaggaggtggaggttgcagtgagccaatatcaagccactgcactccagcctggcacagaacaaggcactctcgggggaaaaaaaaagcgagagagagaaagaaaaaagaaaagaaaatatgggaccctggacgggcgtggtggctcacacctgtaatcccagcactttgggaggccgaggtgggcggatcatgcggtcaggagttcaagaccagactggccagcatggtgaaacctcatctctactaaaaatacaaaaattagccgggcgtggtggtgcatgcctataatcccagctacttgggaggctgaggcaggagaatcacttgaacccaggaggtggagattgcagtgagctgagactgcaccactgcactccagcctggcacagagcaagacactctcttaaaaacaaaaaaaaagaaaagaaaagaaaagaaaaaatatgggaccctataatcccctttccttggcattgataaagatatagactctgtttgggtgaagtgtcctctggcaccgcttacaaatgtgtatctcagactgaataacaaatgcctgggaagaaaactgctgggtccctgagggcaggattcaggaagaatgcacgtgggaggtgcctgatatgagatatcatgatattggggcaatttagatacaatctggaatcaccataagatacgcactttggcgtaaaggcatagcccagttacctggctctctcgcaggggcaggcggggtcacagaggatgctcccggagagaggtcggctggagatggtccacagaccacgtccctctccttcgtcccattcacaagcacagactttccatccaaagaacagcttagacagttcaatgaaaataatttaaataattaacttaggtccagaagattctggtttaaaactttgtcatttttcacccaatgaagtagcctagtgaaaaagatatatgggtctgggttcgaaagcgatgcaaagatattttgaaaaacttccacttgaccatctggctccctgcagctttccatggcttccttctgttcagtgacagcttagttcagtctgtcttgcctgcttagtctctcacccccagtttcttaatcggacttgaccatctccggcacagatgaaggctagcatagggttaggaggtccagcactagcatcaggcaaaccagggtttgagccctgggtctgctgctttccagaatgactttgggcaagtcaagaaatctctgtaaccccagcatggtggctcacgcctataatctcaacactttggtaggctgaggccagaggatcacttgagaccaggcgttggagaccagcctgagcaacatagcaagaccccatctctacaaaaattaaaagacaaacaaaaattaactgatggtgcatgcctgtggccccagctactcgggagactgaggtgggaggatcacttgaacccaggagtttgaggctgatcacttgaacccaggagtttgacgctgtctcagaaagaaaagaaaaaagaaacctccctaagcctcagttttctcatctgcaaaattaggattgtatgtgctgccagaactgtttcaaagaacaaacgagtgagagtcagtgacacactcttgcacatctgacacgctgagtaaatggtagctatcattatcaccatcatcgccatcattgttgctgttgttgtgacacctttcccttgtccctttacctaccccaaatccgcccgtcctccagagcccagttcaaacccatttttccatgcagactcacttaacaactctgaaaaatttgtattgaaagaccttttttaaaaagccactttccagctgggcacagtggctcacacctgtaatcccagcactttgggaggccaaggcaagcggatcacttgaggtcaggagtgcgagaccagcctggctaacatggtgaaagcccatctctactaaaaatacaaaagcactagccaggcgtggttgtgtgcacctgtaatcccagctactaggaggccgaggcaggagaatctcttgaacccaggaggcagagtttgcagtgaggcgagaccgtgccattgcactccagcctgggcaagaagagcgaaactccatctcaaaacaaacaaacaaacaaacaaacaaaacaaacaaacagacctttttaaaaaagccactttccaaagacagaattcagctaagtccgagaaaatagtcaatacttttcttgtgaatcatgattccattcgtcagccactctgatgctgataaattataaatgacaaaagcagagagataccatgattcctgtttcaaaacactttattttctctcaaaaaagtcactttccagtctgttacaaaccaatacacttttgaaatacaataaaaatgtaaaagtaaaataataaaaatgattttctagtaagaaaatgaaacggaaaaagaacaaatacatataaaatacaacgcccaaatttttattcttagtcaacagaccacattactctgccaatttgccttaaaagtttctaaatgtttactctctaaccctacaccactgtcgatggggacacaggacaagccatttgtggaccagcacccatccacagaccacagtgtaagttctggttccacaaaacaacagtcacattctctcgtatactattggctttttaccacctgtgatggccttgtgtgcccaagtctgtgccacattttggagggtaacgagcaattgttagtttcttctgtatcattctaggggctggcattgaacacatggagacaggctgatcaatgagagaagataagaggcagcaaaggaatgagaaggaaacagaaaagaggcagacagcggcaaagttccactggcaattcttttcctttcttttgagacaggctctctgctctggagtgcgatggtgcgatcatagctcattgcagcctcaacctcccagactcaggtgatcctcctgcctcatcagccttccctatagctgggaccacaggcatgtgccattatgcctggctaattttttgattttttgtagagacagggtctcacccaggctggttttgaactcctgggctcaaggagtcctcctgtctcagcctcccaaagtgctgggattacaggcgtgaaccactgcacgtgcccagcctccactggcaattctgatctagatgttccaggcactatttctggagaaaatgcccactttgcctattgagttgctacgacctcacagtgttcccacgctgcctattagtatgttacattctgtctacacttgatgggtgcaaaaaagcttcaatgatagcattccttatcttccaaaaaatttaacccagattctttattccataaactaaaggaaattatacgtactttgtccagggtcgacagatgccacgtttctgatcgttaaatgtcccaaagcaacagtctttacaaccttgtattaaaaatgaaagcaataataaaagggaagcattttcatcattttgtaacttttcctgtgatgaacttaatataagtcattaccataatgcaatctgcacaaattgttcaataattcttgaaacaacaccctaagatggctagtttttattttaattgtacataaagtattgtatatgtctggaacatgtgaagattaatggttctggcaattaacaaatgttctgatttcaaattatttccatttatgaagaaataacggaaatattttattaattgaaatattttattaattaaaatatgatatatcatatactcccttgttactttaaggttctacaaatctgtttgtttattttcaaaggatcaagatcaaagctaagtttgtctatgtcacaaaactacactagatcaaagaaacgcaaacgtacctttttttgtcagttcttgaccttgtttacaatcctgttcacacatgctgcatcctgcccccaggcagtgaaaccctggagtgcagtcacactctgcattgctggtggaggaacactccttcctggtcctgaaaacacctacaaagtccccccagcccccaacattttattacacttgacctccaaatccaggaagcgaatttatgctctgcagtaaaaatcatgctcactctacttatagtgttcccagtaattttaaagtttacttttaaatctccataaagacatttttacatttaggtaagtaaaaacttctctcttgtcaaatgaatgtttcctctaatatttagaaagctcagtccacaaataattgctgtcactggatattattgtcctagacctgctggttggcagaagaatcagtctttgacacttgagattttcaaaagagagcagttagtaaatgggaaagaaaagcttatcttcccaactatcttctagaagaagaaaatatctttgaactcatacctttacactgcctgcatatgtcacaggtcctttgtccacctgcgctggagaaactatttggaggacagggactgcaaatctgattcctgttattatcacagaatgtacctaagaaaggcagacaatagtggtacacgtttgacaatgggcaatcgtcacccaaggcattccgaagtttacaataaaataagattataaaagaatgatgagttttctagatgccacagtggtggacattagtttgattgacttcctaaaacaatacatttgcaagattattctttgtgtaatcacagaattagaaataacaaaatacaggccaggtgcagtggctcacgcctgtaatcacagcactttgggaggccgaagcgggcagatcacctgaggtcagcagttcaagaccagcttggccaacatggtgaaatcctgtctctactaaaaatacaaaaattagccaggcgcagtggtgcacacctgtaatcccagctactcgggaggctgaggcaggagaattgcttgaacctgggaggccaaggttgcagtgagctgagatcgtgccactgcactccagcctgggcgacagagtgagactgtgtctcaaaaaaaaaaaaaaaaacatacacacacaaaaaaaacaaaaaaaccagatattgtaacaaataaatcaacagaaagaaaatactttatctattgaataaaacaaaatgattatcttgattgatgtaggagatgaatatgactggatccaggaggacatcaatgtcctacactaaaatttaaatgcgactgaccgtccccactctgttaagccctttactacgcgcttactcgctgctatgcccccagtcggagcacaaagccctacacacaaaactaacatttattgaagtcttgccttgtgccatgcactgttctaagcccttcatttgatcctcccagccatcctataaaacaggttctcttattatccccagatgagaaagtcaaggcacaagaggttgaatgactttgctgtgttcacacagctaggttgtagcatccaataaacatttgtaaatgaatgaattttcattttcctttccttaaaagggagctcgttagccctgactactagactaactgaaccatacttccaacagagcagatcaaatgcacatgataactgggtactcaccagctgggcagttactacaaggatcctgcaatgatcttgtcctctcaaagttgaggaccagcaacagagtggctactatgttgtaacagctgtttcccatgatgaaatctggcacaggtatgatactagcaaagctgattccaagagaattttaatcaaattagctggtctcacaaatgtcactctgcaaaagataaacatttccaaggaaaggtggtttctcctttcaaaattatctatattgcaatcattacttatacaattctataagaggataactcagggtttttcaggaacaattaatgatgcaatattacggaaaagtagcagattcatagaaaccactaggacaaggcaggcgtgattaaacacacagctttgtgccggtttgccaaagtttgagggtgcattttccatcatgttctgccaaaatgcagaaataacaatagcaagaacttttggggactttcataggtactttgcagtaccaaccagcaataatgccaattacttattgcccctgaaataaactccttacaaagagaatctgtcaggggcatcagacaattcagttcaagaagaagctatcacataatcactcttccccctttagctgaacacctaactactaacatgtggaaagacctccctgttcaactcactaacacattttcttaaacagagacatgttttgagatgtgaagtttgtatggtaacaaaactaaggagtgaaaaactcttcaggctaagttattgatgtttatttaaagggctattgaagagaagttattacatattaggagaaaaagtctagaaatgggcaaagggagcaaaagttccaatctcaccccttctcagtgcccccacccactcccccagatggacagaccttgagatctcagggctgccggagaactttccactccttggtcttcaggcttctgcagctcgagaggacttcaggtcaaacacaggagtgcggtgactcagccaggggcggggtctcatgggaaattcccaccacagctctgtgacagccctatgaaatcattcatttcatatctgctgaccccgaaatcccctagagcccccgtccctgcctgataatggcacttcaaattgcttcttggaagcagctctctactgtcaggatgtgtcacagatgacgctgggaaaacgattttgtcccttaagatagctctccaggacaaagcatttagcatgtccttaaaacactggatttgagattagaggaatgaaaccaaattcaaaacagtgatcagcattttgccatatgcggtcccctaactccatagtcactgtaatgcaatagctgccattacttgagcacagccgatgtgccaggcatcagagatgcactgcggtgaatacacactatcctcgaaagaaccctagaacttggtatgactgctgttgttactgggagaacactatgcaaatgaggaaagtggggctgcaagtggaattagagcgtcaacaggacagggagcaggcagggttggaacccaggtcggcctggtcccttatcgtgctcctccgggcatgggtgacagagggaggaaggagggagaaatggagggaaatggaaacaggggaagcacagcagtcacacggcaagtcaatgaccaggacgtggttcggtgaagctgagagctaggagggatttttagaaaaccatgatttcaatttttctttaaaaaaaaaaaaaggagaaagagaccaggcgcggtgactcatgcctgtaatcccaacacttgggaggccgaggtggatggatcatctgaggtcaggagtttgacactagactgtccaacatggcaaaaacctgtctctactaaaattacaaaaattagcagggaatggtggcggtggacccctttaatcccagctactgaggctgaggcaggagaatcgcttgaacctgggaagtagaggttgcagtgagccgagattgcgccactgcactccagccacaaaaaaaaaaaaaaaaagaagaagaagaagaagaagaggaagaggagggcagagaaagcagaaggaaaaaaaagtacagtaagaggagaggaggagtataaggagaaagaagagggagaagaggaggaggaggagaaaaataaagagaaaaggaggaggaggaggaagaagaaaagaacagaaagagaaggggaagaggaagaggagaaggaagaatgaggaggagaaagaatgagacggaagaatgaggagaaggaagagtgaggaggagaaagaatgagaaggaagaatgaggagaaggaaaaaggggtgtttctggaggaggaggaggaggaggaggaggaggaggaggcggctgctccaggctgtagatgaacctgcccatcattgagcagctggagaacctcaggaaaaccaggggaactgtggctggggcaggcgtgggctggggaaggacatcgagagtagcttgggccgtcctcctgccccgcggttcccagcacgagctctcccgacagaagaggaaaacgcggcgcgactcggttgggggacagcgctgagatgcggacagatgcggacgttctgccgccgcctgcaggcagagggactcggagatcaggccgcagaagcagaagaaggcagacgggaaggaggaggaaggaaaggagccttgtggcttcgtgtccgaccctcccgcccttggcccgcgtgcctggagccagccccaccgcgcccgcgtttcctcccgcgggacttcccttggccctgggtctgcagcgggtcctgccgagcttccttccctcaggcagcctctctctccctggccactctcgggggtgaggggggttaccggttcccagtgatttttattccctttgctctctcacgcctcatgttccccattctcctgcctcagttgtgtaatcttgagcaaatttctcaacctccctaactctgtttttgcaagcacatcttacaggtgcagtgacaccatacatcttcctcgtgagtgaggattaaatgagacgatgagcatgaaatacttagctcaatgcttggcacatagttctcaagaaagtaggaattgctatgatcagacttactggtttgaaatgttccttccctgcctcccacactgaccatcagtagagccaccacagggcaagtcatgacagaaaaggagaaaaacgcatgagctgcctgcaaaatgtgttcccaaatactgacggtcatctgagagttatcttacctgtgacatctgtgggatccctccttg

SEQ ID NO: 309 - DNA, 12923 bp, Homo sapiens
  1st Promoter of TNFRSF9
aaagtgctgggattacaggcgtgaaccactgcacgtgcccagcctccactggcaattctgatctagatgttccaggcactatttctggagaaaatgcccactttgcctattgagttgctacgacctcacagtgttcccacgctgcctattagtatgttacattctgtctacacttgatgggtgcaaaaaagcttcaatgatagcattccttatcttccaaaaaatttaacccagattctttattccataaactaaaggaaattatacgtactttgtccagggtcgacagatgccacgtttctgatcgttaaatgtcccaaagcaacagtctttacaaccttgtattaaaaatgaaagcaataataaaagggaagcattttcatcattttgtaacttttcctgtgatgaacttaatataagtcattaccataatgcaatctgcacaaattgttcaataattcttgaaacaacaccctaagatggctagtttttattttaattgtacataaagtattgtatatgtctggaacatgtgaagattaatggttctggcaattaacaaatgttctgatttcaaattatttccatttatgaagaaataacggaaatattttattaattgaaatattttattaattaaaatatgatatatcatatactcccttgttactttaaggttctacaaatctgtttgtttattttcaaaggatcaagatcaaagctaagtttgtctatgtcacaaaactacactagatcaaagaaacgcaaacgtacctttttttgtcagttcttgaccttgtttacaatcctgttcacacatgctgcatcctgcccccaggcagtgaaaccctggagtgcagtcacactctgcattgctggtggaggaacactccttcctggtcctgaaaacacctacaaagtccccccagcccccaacattttattacacttgacctccaaatccaggaagcgaatttatgctctgcagtaaaaatcatgctcactctacttatagtgttcccagtaattttaaagtttacttttaaatctccataaagacatttttacatttaggtaagtaaaaacttctctcttgtcaaatgaatgtttcctctaatatttagaaagctcagtccacaaataattgctgtcactggatattattgtcctagacctgctggttggcagaagaatcagtctttgacacttgagattttcaaaagagagcagttagtaaatgggaaagaaaagcttatcttcccaactatcttctagaagaagaaaatatctttgaactcatacctttacactgcctgcatatgtcacaggtcctttgtccacctgcgctggagaaactatttggaggacagggactgcaaatctgattcctgttattatcacagaatgtacctaagaaaggcagacaatagtggtacacgtttgacaatgggcaatcgtcacccaaggcattccgaagtttacaataaaataagattataaaagaatgatgagttttctagatgccacagtggtggacattagtttgattgacttcctaaaacaatacatttgcaagattattctttgtgtaatcacagaattagaaataacaaaatacaggccaggtgcagtggctcacgcctgtaatcacagcactttgggaggccgaagcgggcagatcacctgaggtcagcagttcaagaccagcttggccaacatggtgaaatcctgtctctactaaaaatacaaaaattagccaggcgcagtggtgcacacctgtaatcccagctactcgggaggctgaggcaggagaattgcttgaacctgggaggccaaggttgcagtgagctgagatcgtgccactgcactccagcctgggcgacagagtgagactgtgtctcaaaaaaaaaaaaaaaaacatacacacacaaaaaaaacaaaaaaaccagatattgtaacaaataaatcaacagaaagaaaatactttatctattgaataaaacaaaatgattatcttgattgatgtaggagatgaatatgactggatccaggaggacatcaatgtcctacactaaaatttaaatgcgactgaccgtccccactctgttaagccctttactacgcgcttactcgctgctatgcccccagtcggagcacaaagccctacacacaaaactaacatttattgaagtcttgccttgtgccatgcactgttctaagcccttcatttgatcctcccagccatcctataaaacaggttctcttattatccccagatgagaaagtcaaggcacaagaggttgaatgactttgctgtgttcacacagctaggttgtagcatccaataaacatttgtaaatgaatgaattttcattttcctttccttaaaagggagctcgttagccctgactactagactaactgaaccatacttccaacagagcagatcaaatgcacatgataactgggtactcaccagctgggcagttactacaaggatcctgcaatgatcttgtcctctcaaagttgaggaccagcaacagagtggctactatgttgtaacagctgtttcccatgatgaaatctggcacaggtatgatactagcaaagctgattccaagagaattttaatcaaattagctggtctcacaaatgtcactctgcaaaagataaacatttccaaggaaaggtggtttctcctttcaaaattatctatattgcaatcattacttatacaattctataagaggataactcagggtttttcaggaacaattaatgatgcaatattacggaaaagtagcagattcatagaaaccactaggacaaggcaggcgtgattaaacacacagctttgtgccggtttgccaaagtttgagggtgcattttccatcatgttctgccaaaatgcagaaataacaatagcaagaacttttggggactttcataggtactttgcagtaccaaccagcaataatgccaattacttattgcccctgaaataaactccttacaaagagaatctgtcaggggcatcagacaattcagttcaagaagaagctatcacataatcactcttccccctttagctgaacacctaactactaacatgtggaaagacctccctgttcaactcactaacacattttcttaaacagagacatgttttgagatgtgaagtttgtatggtaacaaaactaaggagtgaaaaactcttcaggctaagttattgatgtttatttaaagggctattgaagagaagttattacatattaggagaaaaagtctagaaatgggcaaagggagcaaaagttccaatctcaccccttctcagtgcccccacccactcccccagatggacagaccttgagatctcagggctgccggagaactttccactccttggtcttcaggcttctgcagctcgagaggacttcaggtcaaacacaggagtgcggtgactcagccaggggcggggtctcatgggaaattcccaccacagctctgtgacagccctatgaaatcattcatttcatatctgctgaccccgaaatcccctagagcccccgtccctgcctgataatggcacttcaaattgcttcttggaagcagctctctactgtcaggatgtgtcacagatgacgctgggaaaacgattttgtcccttaagatagctctccaggacaaagcatttagcatgtccttaaaacactggatttgagattagaggaatgaaaccaaattcaaaacagtgatcagcattttgccatatgcggtcccctaactccatagtcactgtaatgcaatagctgccattacttgagcacagccgatgtgccaggcatcagagatgcactgcggtgaatacacactatcctcgaaagaaccctagaacttggtatgactgctgttgttactgggagaacactatgcaaatgaggaaagtggggctgcaagtggaattagagcgtcaacaggacagggagcaggcagggttggaacccaggtcggcctggtcccttatcgtgctcctccgggcatgggtgacagagggaggaaggagggagaaatggagggaaatggaaacaggggaagcacagcagtcacacggcaagtcaatgaccaggacgtggttcggtgaagctgagagctaggagggatttttagaaaaccatgatttcaatttttctttaaaaaaaaaaaaaggagaaagagaccaggcgcggtgactcatgcctgtaatcccaacacttgggaggccgaggtggatggatcatctgaggtcaggagtttgacactagactgtccaacatggcaaaaacctgtctctactaaaattacaaaaattagcagggaatggtggcggtggacccctttaatcccagctactgaggctgaggcaggagaatcgcttgaacctgggaagtagaggttgcagtgagccgagattgcgccactgcactccagccacaaaaaaaaaaaaaaaaagaagaagaagaagaagaagaggaagaggagggcagagaaagcagaaggaaaaaaaagtacagtaagaggagaggaggagtataaggagaaagaagagggagaagaggaggaggaggagaaaaataaagagaaaaggaggaggaggaggaagaagaaaagaacagaaagagaaggggaagaggaagaggagaaggaagaatgaggaggagaaagaatgagacggaagaatgaggagaaggaagagtgaggaggagaaagaatgagaaggaagaatgaggagaaggaaaaaggggtgtttctggaggaggaggaggaggaggaggaggaggaggaggcggctgctccaggctgtagatgaacctgcccatcattgagcagctggagaacctcaggaaaaccaggggaactgtggctggggcaggcgtgggctggggaaggacatcgagagtagcttgggccgtcctcctgccccgcggttcccagcacgagctctcccgacagaagaggaaaacgcggcgcgactcggttgggggacagcgctgagatgcggacagatgcggacgttctgccgccgcctgcaggcagagggactcggagatcaggccgcagaagcagaagaaggcagacgggaaggaggaggaaggaaaggagccttgtggcttcgtgtccgaccctcccgcccttggcccgcgtgcctggagccagccccaccgcgcccgcgtttcctcccgcgggacttcccttggccctgggtctgcagcgggtcctgccgagcttccttccctcaggcagcctctctctccctggccactctcgggggtgaggggggttaccggttcccagtgatttttattccctttgctctctcacgcctcatgttccccattctcctgcctcagttgtgtaatcttgagcaaatttctcaacctccctaactctgtttttgcaagcacatcttacaggtgcagtgacaccatacatcttcctcgtgagtgaggattaaatgagacgatgagcatgaaatacttagctcaatgcttggcacatagttctcaagaaagtaggaattgctatgatcagacttactggtttgaaatgttccttccctgcctcccacactgaccatcagtagagccaccacagggcaagtcatgacagaaaaggagaaaaacgcatgagctgcctgcaaaatgtgttcccaaatactgacggtcatctgagagttatcttacctgtgacatctgtgggatccctccttgccccactttggcagaaattggctgaatgtgagagtgtcacaccataaaaatcggactgctgatcccctcctaacactttgaaagtcaccatctaaccaagtaatctccttgtttacatgtggtactctgtttaacattgcagtgtgacatttaactgggccatatttcatttaactaaatgctactcactagtctacgttttggacattctgtaggcagagacattacttcctctgaaagtgacatatttagtttcccagcacagtaattagctcactatttcaggcttttatgccagtaacataagagtctttactgagctaaaagagtctcaacattagttttgccagcccacagttaaacaaagtcaaccacttcagaattctgctactgaaggctatgctcaactttactcaggcgtttaaaaaattcatggctgggaacagtggctcacacctgtaatctcagcacttagggaggctgaggcaggaggatcgcttgagcccaagagttcaagatgacctggacaagatgcccagaccctgtctctacaaaaaatacaaaaattagctgggtgtggtggcatgtgcctgtggttctaactacttgggaggctgggatgggaggattgcttgagcctgggaggtcgaggttgcagtcagccatgtttgcacctgtgcactccagcctgagcaacaaaactagactgtctcaaaaaaaaaaaaaaaaagaattcatgttactgcatgcatttttgtgtggtataaaatcatcgtagtaagctaagtcaaattatatagttaaccagatatacatactatctaagctagccaaaggtgtaatactcttttggtataattttcatttgctttataacatgtatcatattgctttatccattgtagccctgtaatctttcaaatgcaacaaaagctttttctattccataaaaccatctcaaactaaatcagagatgaccccgacaagacagcaacactttagcagtattaataatattaataatatgtttcatccatcctaagcagtattaataatctgtttcatcacatcctaagcatctcattctaaaccaagaaataggccgggtgcagtggctcatgcctataatcccagcactttgggaggctgaggtgggaggatcacaaggtcaggagatcgagaccatcctggctaacatggtgaaaccccatctctactaaaaatacaaaaaaaaattagcaaggcgttgtggcaggtgcctgtagtcccagctactctggaggctgaggcaggagaatggcgtgaacccgggacacggagcttgcagtgagcccagatcgtgccactgcactccagcctgggcgacagggcgagactccatctcaaaaaaataaataaataaataaaataaaaaaaaaataaataaataaataaaccaagaaatagattttatttcattttgattgactataggtctaatcttgaatatctcaagcagctaaatactttgaggctaaatagcatgaaggcccaacaattctaaacaggataaaggagacatttagaaagagaaagccctcaaaataagcttcctataaaatattcttccgcccttccagggcgcatcttagagggaatctcttccgtgggatattcactgtttacacttgttttctgcctgaaagatctattctttcaagattcagtgtcgccacccctactccaaacacccaaactagtagtcactattagacatacctggtgcttgtgatgtcagtaggtgttctgaggcctgggaaggagtaaattgtttttaaacttggaacaaagaaaatgagcaggaaatcaaagaggaaggaggcagagtaaggagaaggaagtacgaatcataaggagaggcgggtgtcagcagccatcgactttgctcacctttcctccttgttctgccctttctccaggtggcatccactcatatgctaaggcttatcaatagttgtctccaacttcagaccacccccaacactgtgcagtccccaggacaagagtacaaacagaggcctgcttaccatgtgtccaaatatttagaaattgttcatcaatccaaatacgctgttaagtatgttctgtccagagcagagacacaaacacacaaacacaatgaacacagagctgcgtctgtgactgggtgtctggcgcacggtgctggcatagggatgcattaactcggctccatctgctctctggacccacactgccaggcctgggtgaagactcccccacatccctggatccatgtccttgaaactccatttgagggtgacaccgtgctgtgagagttgtgagctgtgctgttgcctccaagaacggcagggagggtgtgagccatagaagtaccaggcagacaaaaggcaagtagatttgtcaaatccatctcagataccaagggtgtaacagattcttgtataatctattattatgcaagaatatcacagacagtggtatttccctacagtcccaagtatcctttttttttttttttttgagacagggtctcactctgtcacccaggctgtagtgcagtggtgcaatcttggctcactgcagcttctgcctccagggttcaagggattcttctgcctcagcctcccgagtaactgggactacaggtgcgcaccaccttgcccagctaagttttatatttttttgtagaaaggggttttgccatgttgctcaggctggttatccacttgcttgatccaatttatggcccacttggtggttttggaagttcttgtatattgccatggaattcacagcagttatgcacaaagtctgaggaagactttgtaatattaaacaattcatattattcttgaatatgcacatatgtaatatgtagaataagaactgcagcattaattctttactagaatcacctaggactgagacccagaatgacaatttcaatttttataaaaatatttaaaacaatttaaatttcaaaagattaaaaatctcagttctttaataaaaataagttttaaatatttgatatttatccactataatttgtttttaattctaatacttttggaacttttagaaaaatgaaaaaacgaatgtaaaaacaaatttaaaattttacatactcaaattcacacattatattaaatacatacaaatgctgtatatgttaagtacaattatattttatttcttaatcctttaagtcattactgtccaaacacaaattatgcgaaattatctattgtaacaaatgaaatgaaagcaaaaaaataaattttctagataaaaatacaattatttatgaactatgtgtgtctttttttttttttgagacgaagtctcgctgtgtcacccaggctggagtgcagtggtgtgatctcggctcactgcaacctctgcctcctgggttcaagcgattctccccactcagcctcccaagtagctgggactgcaggtgtgtgccaccacacccggctaatttttgtatttttagtagagacggggtttcaccgcattggccaggatggtctcaaactcctgaactcaggtgatctgcctgcctcggcctcccaaagtgctgggcttacaggcgtgagtcaccatgcccggccctgtatgcctttatttaccactaatttaaacattttcaggtcatcagaaaacatctacacatttgtaatgttagttaaactcagtcatctttgccaactttgttacataaaaataatttgttatttagttactttgaagacttctctgtgaagtagaatattctccttgcgcttgatttgccacttttaaatattcagacatggtgtgtgggccccatttctatacttgctccaggccccaaaagtgttagagacagcgctgagagacacacagttggtagtcaataaacctttatcaaatgaacaaataaatacatggatttgttcactccagtcctgcggtctgcctgtctcttcatgacctaatgttttaatttcactctcttcctggggaaatcattctggcatgcagaccccaacctgagctgtcattgtcctttctcaggtctcatgtaaaatgcttttctgatcacggctgacactggccgagggcttactatgcgcaaggcactgttctatgtatttacagaagttcccacaattataccttaggacagcctttgtccctgtttcacaggtgaggaaacaagggcacagagaagccaggtagcctgcctggtgtcacctggctagtaaggagccgagaaaggattagaaactcggctgtctggctgcagagcccatgctcttaaccagactcttaacctgcctgtgcccaaggccccattcgcttgtgggtcctatgcttgtggagccctcagaataggattcgtaattcataaaatatattacaaaggattacaaaggaaaccaactgaattgaaatgtccctgccaaatattttaaaagccaatttgtgatgcactaatatatggacttaacatgtatctggcataatttcaaattaatcatgaatcaaaatggtattctgggatatctgcaagaactgtaatgtgatatgaagatgactttcagtactattggtcccaagccatgagtactgttccttcagctatgctttgtgaattactatattccaaatgggaagaaatgttaggtttagatttccattagaggttagtgaaactaaagatgtaatttaaatctaagttcacagactccctgatttttatctgtgcacctttgagcatctgtggacctcagggtcacaacccctgtatgaagtctccttgctgtcgctcatgcgcttaaacagtttgagctctgggaacttgctcttactccaagagcaagcttcactttgattatttctccagatgctgtcattgtatcttaaggcaaaaactctatgtcatttctgtccctcaccatcctcaccaagatggcacatgtttatggtgtatcacattctgtggtccattcctctggtcccttcaacgctgaatttaaacagattgcgactaccactaaataaatgttttctaataacaagagctaatacttatgggtggcttcctgcattgcagatgttatgctaaacactttaaatgttttatttagtctcagaagacagattttgttccttctgaagaggctaaataaaatatttaaagtgttgagcataggccgggtgcggtggctcatccctgtaatcccagcactttaggaggccgaggtgggcggatcacctgaggtcaggcatttgagaccagcctggccaacatggtgaaatcccgtctctactaaaaataccaaaattagctgggcatggtggcgtgtgcctgtagtcccagctgcttgggaggctgaggtgggagaatcacttgaacctgggaagtggaggttacagtgagccgagatcacaccactgccccttagcctgggcaacagagtgagactctgtctcacagatgcacacaaaaaaagtgttgagcataacatctgcaatgcaggaactccatgaggtaagaattattgttactattctaatgtgaagaaacagaagccaagggagttcaattcctgagacaaggattaagggcagcatttgagggtttactccaggccagtgttctagctttacctatattcattcatttaattctcatagtgaccctgtgaagtacacaggttctgtgatccctgttttatagatggggaacatgaggcatgaggggtaactcatttgttcaagatcacttagctagcatgggacagagctgggcttaaatccagacaggctggactcagagagcgagaacaggctctcccaccacaccatactgccacatttaaggaatggagacaccagggatggaattggacgctgtctcattccaaagctaccttaacatctggccaagaggtatgactaacataggagctagctgtaatggcacattcctgtgaattagtaaaaagatgtgttgactcagcaaccaagggtaagactgtcaattccgtggtttaagagctgagttggaaaccacatcagagctcgtctacatgaatgactaccaagaaactgacgatcaatttaaactttgagaaatgtgatgaagagcagaattgacagcctcatagtagtcaatttttggaggaagttagactagcttaaaataagagcacgtaatcaaaaaccattaagtaaacacgggctctttatttttaaattcggatggcgagagatagttgctacatgccgttaaagggaaaactagtctttggggtgcaggtgacaactgtgatcaaagcagtatcaccccaagaggcaacattatcctgaagtaacataactttgtaccgaaggccagcttctggctgtggggtactagctccccgtccctagcgttcaccttaacccttgggaaggaaagtactattaaaattaagtaatatacaaattcatctcaactactgtcaattaacattctagtgtccttattcaacaaatcaaaagcaaggcaacaccaggagatggattttgtttccttctgagctttttaatggtgatcagcattttctaccaaataattccactcacaagtcgttctccacaaaatccgtctcctgttcttctgtgtttccattataatggaagattgttggataaaccattagttttcataagattttttttcttcagttaagtatcaccatactaaataagtatcaccacacaaaataagagttccaactgtccctgtgtgtaagttataactactccatatatatgcctatagggtctgttgcactcaacctcaagcaatttccaagtttcattattattatcattagattactctctgtcccttatcaattcagtaaatttaactcaacaagcatttatcgaatgtctaatgcaaatctgcacattttctaacccatttacttctcctgttttgcatcctaccactcccctctagcctgacttgttttcaatttttaaatttttatttatttttgagatggagtcttgctctgtcgcccaggctggagtgcagtggcaccatctcggctcattgcaacctccgcctcctgggttcaagcgattctcccacctcagcctcccgagtag

SEQ ID NO: 310 - DNA, 17089 bp, Homo sapiens
  1st Enhancer of TNFRSF9
tactgctccgcaaatttcaatcctaagcagatatttatttacagactggcaaggcaaaaagtcctaccccgatttcatatgcttgttgctataaaaaataaccacaccatctcctagaacttatgaaaaactggcaagatgttcagaaataccaacgggatgtcttttgaaattgttcccaggttgaatttcaaaatggagatctcttctggaaagattgagatgtcatgttttccgtatttgtcctgctgagtactgctgaaaacctctcagaaaggcagagagaggaaggccaattgggtcaggatctccagacccaagaaacaacatggcaatgggtttctttctgcctcatttccctctgactgggaactagagaagcagcactctaaaaatgccaatagcgtggacaaaacaaagcaaaaaccaagaagaggccaggcgtggtgactcacatctgtaatcccagcactttgggaagccaaagcaagcagatcatctgaggtcaggatttcgagaccagcctggccaacatggcgaaaccctgtctctactaaaaacacaaaaattagctgggcatggtggcgctcacctgtaatcttagctattcgggagtctgaggcaggacaatggcttaaacccaggaggcagaggttgcagagagctgagattacaccactgcactccagcctgggcaacagagcaagactccatctcaaaaaaacacataaaaaactaagaggagcttgtactctctagttatgagaccaggaaaggggcagcatagcaagactacaaacttcttttttttttcttttttttttttgagatggagtctcactctgttgcccaggctggagtgcaatggcgtgatctcagctcactgcaacctccgcctcttgggttcaagcggttctcttgcctcagtctcctgagtagctgggactacaggtgcccgccaccaggcccggctaatttttgtgtttttagtagagatggggtttcaccatattggccaggctggtctcaaactcctgaccttatgatccgcccatctgggcctcccaaagtgctgggattacaggcgtgagccaccacacctggtccaaaaacttctagacaataaccactcaattctaacaaaacaccacaaaaaacaccgtggctccgcctgcaagcccaccaggaaggactgagtagagagcctggacttccaccctcacggctgattaaggctcatctccccctccctcctggggtagtgtcagaggaggcctagtgggagctagaactcccacgtgtctagcagtaaaaaggagaccctcaccctccaggaggtatagcatagaacccaaacttcctccacccctgcctggccgtaacgagctgcccatcctccttccttccctagagtgatgtcagaggaaccctgagaaaatacaagatctaaattagatccagaaactgggtgtgggggctcacgcctgtaatcccaatactatgggggccaaggcaggaggatcgcttgagtccaggagttctagaccagcttgggtaacagagcaagaccctgtctctacaaaacatttaaaaattagccaggggtggtggcacatgactgtagtctcagctactctggaggctgaggtgggaggatcacttgagcccaggaagttgaggctgcattgaggcgtgatcatgccactgcactcccgcctgggtaatagagcaagcaagaccctgacttctaaaaaattttttttttacttaggcctaaatctaacaaaacacatacagaacttgtatagtgaaaactacaaaatgctggtgaaataaattttaaaatgtataaatgaagagacatactatgttcctgcattagaatacagtcatacagcgtacaacaacgttttggtcaaaaacagactgcatatatgatcgtggtcccataagattatagtggagctgaaaagttcctattgcctcgtgatgtccaaccatcataacattgcagcacagctcattgctcacgtttgtggtgatactgatgtaaaaaacctactgagctgccagttgtgtaaagtgtagcatatgcaattatgtacagcacataatccttgacaatgacaataaatgactatgttagtagtttatggacttactataccatactttttatagttatttcatagtatattccatatatatatatatatatatatatatatatatatatatataaccagttaaggccgggtgttgtggctcacacctgtaatcccagcactttgggaggccaaggcaggtggattgcctgagctcaggagtttgagactagcctgggcaatttggtgaaaccctgtctctactaaagtacaaaaaattagccaggcatggcggcatgcacctgtaatcccagctactcgggaggctgagacaggagaatcccttgaacccgggaggcagaggttgcagggagccgagaccgccccattgcactccagcctgggcaacagagcaagactcctctcaaacaaaaaacaaacaaacaaacaaacaaacaaaaaccagttaattgtaaaacagcctcaggcaggtcctttgggaggtattccagaagaagacattgttctcataggagatgacagctacatgcatgtttttgccccaaagatcttccagtgggacaagatgtggaggtggcagacaccaactctgtgtgggtctaggctaataagtgtgttcgtgtcttagtttttcacaaaaaaagtttaaaaagtaaaaagcaatttaaaaacttttaaatagataaaagcttatagaataaggaaataaagagaaaatatttttgtacagctgtacaatgtgcttgtgttttaagctaagagttattacaaaagagtcaaaaagttaaaaaaaattttttttaagtttataggctgggtgcggtggctcatgcctgtaatcccagcactttgggaggccgaggtgggcagattaccggagctcaggagttcgagaccagcctagccaacatggtgaaaccccatctctaatacaaaaattagccaggcgtggtggcagctgcctgtagtcccagctacttggggggctgaggcaggagaatcacttgaacctgggaggtgcaggctgcagtgagccaagatctcgccactgcattccagcctgggcagcaagaccctgcctcaaaaaaaaaaaaattaaagtttatgaagtaaaaagtcacagtaagctaaggttaatttattattgaagaaagagaacattttaaataaatttaggttagcttaagtgtacagtgtttataagactacagtgatatacagcagaggtccccaacctttttggcaagagggaccagttttgtggaagacaatttttccacggactgggtgggtggggggatggtttcaggatgattcaagcacattacatttattgtgcactttatttctattattattactttgtaatatataatgaaataattatacaactccctgtaatgtagaatcagtgggagccctgagcttgttttcctacaactagacagtcccatctgggggtgatggggaacagtgacagatcatcaggtactggattctcataaggagcgtgcaacctcgatccctcgtatgcgcagttcacaataggattcatgctcctatgagaatctaatgccgctgctgatctgatgggagatggagataaggcggtaatgcaagtcatggggaggggctataaatacagaggaagcttcacgtgcttgcccaccactctcctcctgctgggtggcctggtttctaatggcgtctcactctgttgcccagccaggagtgcagtgatgcgatctcggctcactgcaacctctgcctgtcaggttcaagggattctcccacctcagcctcccaagtggctggaattacaggcatgcgccaccacacccggctaatttttgtatttttagtagaaacagggtttcaccatgttggccaggctagtctcgaactcctgacctcaggtgatctgcccaccttggtctcccaaagtgttgggattacagacatgagccactgcgcctggcaaagatcatattattttcacggtacctcttctatgtttagatatgtttagctacacaaataccattatgttacagttgcctatggtattcggtacagtcacatgcctgacaggtttgtagtataggagggataggctataccatccagcctaggtgtatagtaggctgtaccatctaggtttgcataagtgccctctatgatgttcacacaacaacgaaatcacttaacaacacatttctcagaactacccctgtcattaagtgatatgtgactgtacttcacatagtaaagatgtcaatttgcccgaaactgatatgcagatttaacacaattgttatcagaatcccagccggctttttgtagatatagatattatcctaaaatgtatgtggaaatgcaaaggaactagaatagataaaacaattttgaaatgaaataataaagtgggagagactaccaccctctacccaatttcagtatttatgtataactacagtaatcaaggctgtgtggtattggcagaagaagaaacacatggatcaatggaacagaagagggaaaccagatagccccacgtaattgcagccaactgactttgacaaaggtacaatgaaggatgactaatgttttccactagtggtgctagagcaattggacgtccatagtccaacaacaaaaacaacaacaaaaaacttggctaaaacctctcacaccttatacgaaaaatttaaaacgaatcaagcatgggcacagtggctcacacctgtaatcccagcactttgggaggccaaggcaggaggattgtttaaggccaggagttcaagaccagcctgagcaacatggtgagactctgtctcaaaataaaaaaaaaaattacccaggcatgcagagagccaaagcccgtgagacgtgaccaactcaacattccactggaggctatatgatcaaacagcaaagtgttcatcacgaatgcaagatgtgagcaaactcacactgccctgccaccaaaaagtttgctgagggacgctactccctggctccttgaagttatctattgagaaatctagcacctattgttcaaaggatgcagtctcacaagcctgctgtgaaccaaacaccaaacggctaactgacaattacccgacaatcatccccgctttctcactatctcttttgcctaataaatacggagggctgtgtaaagctcagggcccttgtccactagaggcaaggtgccccctgaccccttcttccaaatatactcttttgtctcgtcttttattcccgcttttgcccccctttgttcagtccaataggtccacagcaagtgctggcacactcctgtagtcccagctacttgggaggccaaggagggaggatcacttgagcccaggaggtggaggctgcagtaagccatgatcacaccactgcactccagcctgggtgacaaagcagagaccctgtctcagaaaaaaaaaatcaagatttaaatatgaaatagaaaactgtaaaagttataagagatagaggaaaaaaaaaaaccctaaatctttgagacccaggactcagtgaagaattcttagacatgactccataaatgaaaaaatccataaactggacttcagcaaaattaaatagcttttctctgtggaagagcctgagaagaggatgaaaaggcaagctactgactgggagaaaatatttataaaccatatatatgccaaaggactcctatctgggaaatacgaagaactcttgaatctcaacagtaaaacaaacaaataatccaactagaaaataggtgaaagacctgaacaacacttcactgaagaagatataaagatggaaaataagcacatgaaaagatgtccacccataagggaagtgcaaattaaagccccaatgagatgtcactacatacctattagaacagctgaaataaaaattgtggcaatgcaaaatgcaagcaaggatgcagagaaactccgatgagaatgtaaaatgatacacttcctctggaaaatagttcgacaacttcttaaaaactaaacaagcaccaaacatatagcccagcaattgcactcctgagcatttatcatagagatacaaaaatacatgtccacacaaaacctgtacataattattcctcgcagctttatatgtaatagtcaaaacaggaagcaaacaaaatatcttttaatgggtgcatggtaaaacaaactgtggcacaagcatatcgtggaatactattcagcaaggaaaaagaattaaccattgaaacacacagcaacttggatggatatcaagggcattgtgctgagtgaaaaagcaaaatcttaaaaaaagttcacgtttgtgaaagttgtcagaatcaaaatggagtaacttgtgtcaaaaccctgacaaatgggccgggcatggtggctcatgcctgtaatcccagcactttgggagactgaggcaggcagatcacatgaggccaggagttcaagaccagcctggccaacgtggcaaaaccccgtctctactatagccgggcatggtggcagctgcctgtaatcccagctactcaggaggctgaggcacgaaaatcgctggaacccaggaggcggaggttgcagcgagtggagatcacgccactgcactccagcctgaatgacacagggagatcctgtctcaaaaacaaacaacaacaataacaacaaaaaaccaaaaaacaaacaaacaaacaaaaaccctgacaaatggagccagggaaggccgtgaagggggtttcttatgcatgcatgcctgataaaaacaactatcacaaaagatggcagaaaccacaaccttgcaccaaggctactgtatcttaacaaaaaaatacttctgccggtattgatctttgtagcaaaggataattgtttcaaaataacttacataaccctcctcagtttttcttttttttctttttcctttttttttttttttttttttgagacagagtcttgctctgtcgcccaggctggagtgaagtgcaggatgcgatatcagctcactgcaacctccgcctcccaggttcaagtaattcttgtgcctcagcctcccaagtatctgggattacaggcacgtgccaccatgcagggctaactttttgtatttttagtagagatggggtttcaccatgttggccaggctggtctcgaactcctgacctcaggtgatccatccgcctcagcctcccaaagcgctgggattataggcatgagccactgtgccccgcccctcattttttcttttaaaaactcgcatcacctttacatccctgaatacacccaccgtattcccactgcaatgctactcctgaaaaaatataatcttttagagaggctctctctatctatgatttagcttgacacataccatatgattctatttataccatattccttaaataacaaaagtatagagatgaaagacagataagtggttgccaggggatggtggggagaggtagaggacctaactagaaaggaatagtggaaggagatctctgtggtgatggatagttctgattttattgtgctggttgttatacaactccacatgtgtgataaagggacaaacaactacacacgcacactgtgccaatgtcaatttcctgctttgccattgtactggagaatggaacccagaaaccgcatgagagatgttcctgtcttggcaaattcctgtgaatctataattacgtcaaaattgaaagttcttttgaacgacctaaaacctttttttttttttttttttgagacggagtttcgcttttgttgcccaggctggagtgcaatggcacgatctcagttcactgcaacctccacctcccgggttcaagcgattctcctgtctcagcctcctgagtagctgggattacaggcatgcaccaccacgcctggctaattttttgtatttttagtagagacggggtttcaccatggccaggctggtgttgaactcctaacctcaggtgatctgcccgcctcagccccccagaatgctaggattacaggcgtgagccacagcgcccagccagaaggaaggcttccctgaccaggaatcgaacccgggtcgtgatggcgagcgcggaatcctaaccactagactaccagggagtgtcctaaaaacttttaaaaaatggattacagttccattgaaactcactaattactcataaatacttttgaaaagcattttataacgaactttgttgcagtctggggtgtggatggaactttgttgcagagatactcctttaaatcaggattaagtccagcactttgggaaaccgaggtgggaggatcgcttgagcccaggagtttaagactggcctggacaacaccgtgaatcccagtctctacaaaaacactaaaaatcaattaaaaattagctgagtgtggtggtatgcacctatagtcccagctatttagtaggctgaggcaggaggattgctcgagctctggagttcgaggctacagtgagctgtgatcgcaccattgcacttcagcctgggtgacacagtgaaactctgtctcaaaaaaacaaaagacaaaactgaaatcaggtttaagtgagaacgcagaggtttaaactggaggtgtagacctcaaaaaaagaatgaaagagcaaaccacagaataggaaaagatatttgcagctcatgaacagcagactaaaaacttcctatacgttagtaagaaaaggacagacaatcctatgagaaaatactcaaaagacttgatcaggcccttcactaaagaggaaatccaaatagccaaaataacatgaaaaggcgtctaacctcactagcaaccaggaagtgtaagttaaaaccacaatgagatacaactatccacccaccatatcgataaaaataatctgatgataccaagagttatcaggggatgtggagtaacaggaaactcattaccgccaggggagtgtaaatggggtccaatcatttaggaaaacagtttggcatattcacgaccaagatacacatgttccttgtagctcagcaacgttatttctaggttaaaaaacaaaaccaagccagaaacacgtgtttacgtgtgctgagatacacggacaaaaatattcaaacgtcattacatgtaataaccccaagctggaaatgatcccgctgtccatcagtactagaataggtgaacaatgatgtcatcattcaacaagagtgtgcaacagtggaaatcaactaaagatgaactcaacatggatgaatcttcatgatacaacgttgaaagaagaagcaagatacagaaaacagtgtgattctatttgtatgaagttcacaagcagcccaataaaactgtgttattaggtagcaaaactacagcaaaaggaagttaataccatacaagtctagatgtggttagcagtagtgggcaaagagggctgtgatctagaaagggcatgccaagggcttcgggaatgagttatgttccacttctttaccctggtagagttatttgaatgtttgtttacaacaatttgttaaactttacatttatgcatttttctgtataggtcacaatgtataaaagttctatattgctttaaaaagagcctttaaatacattagcataatttattagataagactttactggctgagcgcagtggctcacgcctgtaatcccaacactttgggaggctgaggcgggcggatcacctgaggttgggagttcaagaccagcctggccaacatggagaaaccccgtctctactaaaaatgcaaaattagctgggtgtggtggcgcatgcctgtaatgcctcgggagcctgaggcaggagaatcgcttgaacccggaaggaggaggttgcggtaagccgggatcacgccattgcactccagcctgggcaacaagagtgaaactctgtctcaaaaaagaaaaaaaaagactttactaatgctgttcctgcatatatatttttaacaatctccaaataggcacattctggtcttacatggtgctttgggttaaaattttgctctcaaaaagctccttttattatatccctcttattaagtcttattaagcctgttatgtctcatcctaatgtccatgaagacaaaaaacagattgccttccatctatatactttttcaaataaatatcaatggcttttgtctagtggatgctgactcagtgccaggcacttgctgagtaccttacagaaataattgttgaacaagtgaatgaatgaaattcattattgaaatttttcatgtaatccatactggtgctgtaataattcatttgttaaacccccttcaagctccctctttgttctccttgccttcctcaaatatgggtctaaactcattttaagccagtttatcaaccagagggacatagagggaacatggttttctgattcttctttgccagtgtcctccacacgcacacacacacatacacacacgcacgcacgcgcacacacacacgcacacacacacagacacgcacacacacacatacacacacacacacacatacacatacatgcaataatccaaggctgcagcatatttaaatctgtcatttttctagaaccgaggtgtgctcttctatatgcaagctttctccacctcagcactattgacatttggggcagcatcattctttgctgggaggctgtcccgtgcacggtaggagttgagcagcattgctgacctctactcactagatgcaatagcccctaatcaccaccatcaccaccgagcggtgaacactgcaactgtctccagacactgcaaatattcccagggacgaaattgcccctgcgtgatagccacggggctatatgaacctcatttctagaattttttttaaaatcatattttcctttctattataaaaagccttgccttgccagagctgtaatatgattatgttaatcttacgttgtttgaatatatacaggagtttctttctgccccgtttaacaacagagaaacggagcgtgaggaagaacagcaggaagagcaacgcagtcgacgtcagcgcaagaaagaaggagatgatctgcggagagtgtcctgcaaaacacagcaaaaggagaaacgcatgcagaaatgtgttgacactcatacacccatgtatatatttacattggtaaatttctaagcatgagaagaatcacagccttgggcatctccaacctgctaatggagtaaacttagaaaacttttaaagaggccagacatggtggctcacgcctgtaatcccaacactttggaaggccgaggcaggaggatcacttagagtcaggagttcaagaccagcctggccaacatagtggtggcaggaacttgtaatcccagctacttggcaggatgaggcaggagaatggcttgaacccgggaggcggaggttgcagtgagctaagatggtgccactgcactccaacctgggcaacagagtgagactccatctcaaaaaaaagaaaagaaagaaaagaaaaagagaaacttaatggcagggagcggtggctcacacctgtaatcctagcactttgggaggccaaggtgggcagatcacctgaggtcaagagtttgaaaccagcctggccaacatggagaaactccatctctactaaaaatacaaaaattagctgggtgccgtggtgggcgcctgtaatcccagctactcaggaggctgagtcaggagaatcgcttgaacctgggaggtagaggttgcagtgagccgagattgcgccattgcactccagcctgggtgacagagagagactctgtccacccccccaaaaaaataaaagaaacttaataattgagcagtttatcctttctagcacatagaaaatatgggacctggggaccaggcgtggcggcttatgcctgtaatcccaacactttgggagcccaaggcaggaggattgcttgagcccaagagtttgagagcagcctgagcaacatagcaagaccccgactctgccaaaaaaataaaaaattagccaggtgtagtggtgagtgcctatagtcccagctactggggaggctgaggtgggaggattggttgagcacaggaggtggaggttgcagtgagccaatatcaagccactgcactccagcctggcacagaacaaggcactctcgggggaaaaaaaaagcgagagagagaaagaaaaaagaaaagaaaatatgggaccctggacgggcgtggtggctcacacctgtaatcccagcactttgggaggccgaggtgggcggatcatgcggtcaggagttcaagaccagactggccagcatggtgaaacctcatctctactaaaaatacaaaaattagccgggcgtggtggtgcatgcctataatcccagctacttgggaggctgaggcaggagaatcacttgaacccaggaggtggagattgcagtgagctgagactgcaccactgcactccagcctggcacagagcaagacactctcttaaaaacaaaaaaaaagaaaagaaaagaaaagaaaaaatatgggaccctataatcccctttccttggcattgataaagatatagactctgtttgggtgaagtgtcctctggcaccgcttacaaatgtgtatctcagactgaataacaaatgcctgggaagaaaactgctgggtccctgagggcaggattcaggaagaatgcacgtgggaggtgcctgatatgagatatcatgatattggggcaatttagatacaatctggaatcaccataagatacgcactttggcgtaaaggcatagcccagttacctggctctctcgcaggggcaggcggggtcacagaggatgctcccggagagaggtcggctggagatggtccacagaccacgtccctctccttcgtcccattcacaagcacagactttccatccaaagaacagcttagacagttcaatgaaaataatttaaataattaacttaggtccagaagattctggtttaaaactttgtcatttttcacccaatgaagtagcctagtgaaaaagatatatgggtctgggttcgaaagcgatgcaaagatattttgaaaaacttccacttgaccatctggctccctgcagctttccatggcttccttctgttcagtgacagcttagttcagtctgtcttgcctgcttagtctctcacccccagtttcttaatcggacttgaccatctccggcacagatgaaggctagcatagggttaggaggtccagcactagcatcaggcaaaccagggtttgagccctgggtctgctgctttccagaatgactttgggcaagtcaagaaatctctgtaaccccagcatggtggctcacgcctataatctcaacactttggtaggctgaggccagaggatcacttgagaccaggcgttggagaccagcctgagcaacatagcaagaccccatctctacaaaaattaaaagacaaacaaaaattaactgatggtgcatgcctgtggccccagctactcgggagactgaggtgggaggatcacttgaacccaggagtttgaggctgatcacttgaacccaggagtttgacgctgtctcagaaagaaaagaaaaaagaaacctccctaagcctcagttttctcatctgcaaaattaggattgtatgtgctgccagaactgtttcaaagaacaaacgagtgagagtcagtgacacactcttgcacatctgacacgctgagtaaatggtagctatcattatcaccatcatcgccatcattgttgctgttgttgtgacacctttcccttgtccctttacctaccccaaatccgcccgtcctccagagcccagttcaaacccatttttccatgcagactcacttaacaactctgaaaaatttgtattgaaagaccttttttaaaaagccactttccagctgggcacagtggctcacacctgtaatcccagcactttgggaggccaaggcaagcggatcacttgaggtcaggagtgcgagaccagcctggctaacatggtgaaagcccatctctactaaaaatacaaaagcactagccaggcgtggttgtgtgcacctgtaatcccagctactaggaggccgaggcaggagaatctcttgaacccaggaggcagagtttgcagtgaggcgagaccgtgccattgcactccagcctgggcaagaagagcgaaactccatctcaaaacaaacaaacaaacaaacaaacaaaacaaacaaacagacctttttaaaaaagccactttccaaagacagaattcagctaagtccgagaaaatagtcaatacttttcttgtgaatcatgattccattcgtcagccactctgatgctgataaattataaatgacaaaagcagagagataccatgattcctgtttcaaaacactttattttctctcaaaaaagtcactttccagtctgttacaaaccaatacacttttgaaatacaataaaaatgtaaaagtaaaataataaaaatgattttctagtaagaaaatgaaacggaaaaagaacaaatacatataaaatacaacgcccaaatttttattcttagtcaacagaccacattactctgccaatttgccttaaaagtttctaaatgtttactctctaaccctacaccactgtcgatggggacacaggacaagccatttgtggaccagcacccatccacagaccacagtgtaagttctggttccacaaaacaacagtcacattctctcgtatactattggctttttaccacctgtgatggccttgtgtgcccaagtctgtgccacattttggagggtaacgagcaattgttagtttcttctgtatcattctaggggctggcattgaacacatggagacaggctgatcaatgagagaagataagaggcagcaaaggaatgagaaggaaacagaaaagaggcagacagcggcaaagttccactggcaattcttttcctttcttttgagacaggctctctgctctggagtgcgatggtgcgatcatagctcattgcagcctcaacctcccagactcaggtgatcctcctgcctcatcagccttccctatagctgggaccacaggcatgtgccattatgcctggctaattttttgattttttgtagagacagggtctcacccaggctggttttgaactcctgggctcaaggagtcctcctgtctcagcctcccaaagtgctgggattacaggcgtgaaccactgcacgtgcccagcctccactggcaattctgatctagatgttccaggcactatttctggagaaaatgcccactttgcctattgagttgctacgacctcacagtgttcccacgctgcctattagtatgttacattctgtctacacttgatgggtgcaaaaaagcttcaatgatagcattccttatcttccaaaaaatttaacccagattctttattccataaactaaaggaaattatacgtactttgtccagggtcgacagatgccacgtttctgatcgttaaatgtcccaaagcaacagtctttacaaccttgtattaaaaatgaaagcaataataaaagggaagcattttcatcattttgtaacttttcctgtgatgaacttaatataagtcattaccataatgcaatctgcacaaattgttcaataattcttgaaacaacaccctaagatggctagtttttattttaattgtacataaagtattgtatatgtctggaacatgtgaagattaatggttctggcaattaacaaatgttctgatttcaaattatttccatttatgaagaaataacggaaatattttattaattgaaatattttattaattaaaatatgatatatcatatactcccttgttactttaaggttctacaaatctgtttgtttattttcaaaggatcaagatcaaagctaagtttgtctatgtcacaaaactacactagatcaaagaaacgcaaacgtacctttttttgtcagttcttgaccttgtttacaatcctgttcacacatgctgcatcctgcccccaggcagtgaaaccctggagtgcagtcacactctgcattgctggtggaggaacactccttcctggtcctgaaaacacctacaaagtccccccagcccccaacattttattacacttgacctccaaatccaggaagcgaatttatgctctgcagtaaaaatcatgctcactctacttatagtgttcccagtaattttaaagtttacttttaaatctccataaagacatttttacatttaggtaagtaaaaacttctctcttgtcaaatgaatgtttcctctaatatttagaaagctcagtccacaaataattgctgtcactggatattattgtcctagacctgctggttggcagaagaatcagtctttgacacttgagattttcaaaagagagcagttagtaaatgggaaagaaaagcttatcttcccaactatcttctagaagaagaaaatatctttgaactcatacctttacactgcctgcatatgtcacaggtcctttgtccacctgcgctggagaaactatttggaggacagggactgcaaatctgattcctgttattatcacagaatgtacctaagaaaggcagacaatagtggtacacgtttgacaatgggcaatcgtcacccaaggcattccgaagtttacaataaaataagattataaaagaatgatgagttttctagatgccacagtggtggacattagtttgattgacttcctaaaacaatacatttgcaagattattctttgtgtaatcacagaattagaaataacaaaatacaggccaggtgcagtggctcacgcctgtaatcacagcactttgggaggccgaagcgggcagatcacctgaggtcagcagttcaagaccagcttggccaacatggtgaaatcctgtctctactaaaaatacaaaaattagccaggcgca

SEQ ID NO: 311 - DNA, 7533 bp, Homo sapiens
  CpG Island of TNFRSF9
agaaactgacgatcaatttaaactttgagaaatgtgatgaagagcagaattgacagcctcatagtagtcaatttttggaggaagttagactagcttaaaataagagcacgtaatcaaaaaccattaagtaaacacgggctctttatttttaaattcggatggcgagagatagttgctacatgccgttaaagggaaaactagtctttggggtgcaggtgacaactgtgatcaaagcagtatcaccccaagaggcaacattatcctgaagtaacataactttgtaccgaaggccagcttctggctgtggggtactagctccccgtccctagcgttcaccttaacccttgggaaggaaagtactattaaaattaagtaatatacaaattcatctcaactactgtcaattaacattctagtgtccttattcaacaaatcaaaagcaaggcaacaccaggagatggattttgtttccttctgagctttttaatggtgatcagcattttctaccaaataattccactcacaagtcgttctccacaaaatccgtctcctgttcttctgtgtttccattataatggaagattgttggataaaccattagttttcataagattttttttcttcagttaagtatcaccatactaaataagtatcaccacacaaaataagagttccaactgtccctgtgtgtaagttataactactccatatatatgcctatagggtctgttgcactcaacctcaagcaatttccaagtttcattattattatcattagattactctctgtcccttatcaattcagtaaatttaactcaacaagcatttatcgaatgtctaatgcaaatctgcacattttctaacccatttacttctcctgttttgcatcctaccactcccctctagcctgacttgttttcaatttttaaatttttatttatttttgagatggagtcttgctctgtcgcccaggctggagtgcagtggcaccatctcggctcattgcaacctccgcctcctgggttcaagcgattctcccacctcagcctcccgagtagctgggattacaggcacctgccatcatgcccggctaatttttgtatttttagtagagatggggtttcaccttgttggccaggctggtctggaactcctgacctcaggtgatccgcacacctcggcctctcaaagtgctgggattacaggtgggagccactgcacccggccactccctcatcttatttgggttttctcctcagaaaacagcattctttgaccagtgtctaaacgagcaccctccccccaccattattctccatcttctctccctcctttgttttccttcatagtacataccaccacctggcatgctatttatttgtgcttttgtttactgtctgtcgtttccccatggaacataagctccatgagaggggacactgttcactgctgcatccctggcaccccagagcactcctgagaacacacaacaagccctccataaataattgtggagtgagttttattgtcttgtatggcatatatagataaagtgccatcccaacagttttcccagccttgagtggaaggaagaggttacacaaataactaaggccacacagccgtacagattctataataggagggcaaagtgctacgggaatagagaaagtttcctggagggattggcagtgtaactgggttttccaggatgggtaatacattgaaaggctgataaaggccgggttcggtggctcacgcctgtaatcccagcactttgggaggctgaggcaggtggatcatgaggtcaggagttcaagaccagcctggccaacatggtgaaaccttgtctctaccaaaaatacaaaaattagccgggcatggtggtgggcgcctgtaatcccagctactcaggaggctggggcaaagaattgcttgaacccgggaggcagtggttgcagtgagccgagatcgagccactgcattccagcatgggcgacaaagcaagacttcgtctcaagaaaaaaaaaaaaaaaaaaaaggaaaaaaaggctgacatggaagcagaggtattcccggcagaaggaaatgcttttgccaaagcacgaaggaagtgaagttccaggaagttcccagaacagataaactgagtgagggagtgttaagaggtacgaatgtggaagataagaaagaagggatttttgaagcacattgtggcaggattcaaacttttaatcccctacatagcagtcactgccaaattcagcagattcacagaactacagacatacgaaaggtcaccagaatatagttctcatcctgaatgtagccactgcttaccaacctccagagtaggtgggcctcaagataaggaagggatctcccggatacagtaaaggatagggggcagggagtcagccaggaaagttttgctagattcaagtgtctaccgctgggtggaatatggattttgccttgcccattgacagaaatactggtgtaactccttgatcactgtatgtctccaaagcattggaatttgaaagcattatggaaacagaattagagaattataacaggaaatagtaagggactcaacatttcaactcctttgagcttgttttatgtaagatctcactaggtcctcaccaacctctgggcaggcattgctattcacatttgcaagtaagttatcgtaaaggctttttgataacccctgactgaaaccctaagtaatgggatcttactctcacttcaagaaataagatcctctccctctccctctccctctccctctccctctctctccacggtctccttccacggtctccctctgatgccgagccaaagctggacggtactgctgccatctcggctcactgcaacctccctgcctgattctcctgcctcagcctgccgagtgcctgcgcacgccgccacgcctgactggttttcgttttttttttttgtggagacggggttttgctgtgttggccgggctggtctccagctcctaaccacgagtgatccgccagcctcggcctcccgaggtgccgggattgcagacggagtctcgttcactcagtgctcaatggtgcccaggctggagtgcagtggcgtgatctcggctcgctacaacctccacctcccagccgcctgccttggccccccaaagtgccgagattgcagcctctgcccagccgccaccccgtctgggaagtgaggagcgtctctgcctggccccccatcgtctgggatacgaggagcctctctgcctggctgcccagtctggaaagtgaggagcgtccctgcccggccgccatcccatctaggaagcgaggagcgcctcttccccgccgccatcccatctaggaagtgaggagcgtctctgcccggccacccatcgtctgagatgtggggagcacctctgccccgccgccctgtctgggatgtgaggagcgcctctgctgggccgcaaccctgtctgggaggtgaggagcgtctctgcccggccgccccgtctgagaagtgagaaaaccctctgcctggcaaccgccccgtctgagaagtgaggagcccctccgtccggcagccaccccgtctgggaagtgaggagcgtctccgcccggcagccaccccgtctgggagggaggtggggggggggtcagccccctgcccggccagctgccctgtccgggaggtgaggggctcctctgcccggccagccgccccgtccgggagggaggtgggggggtcagccccccgcccggccagccgccccgtccgggagggaggtgggggaatcagccccccacccggccagccgccccgtccgggagggaggtgggggggtcagcccccccacccggccagccgccctatccaggaggtgaggggcgcctctgcccggccgcccctactgggaagtgaggagcccctctgcctggccagccgccccgtccgggagggtggtgggggggtcagccccccgcccggccagccgccccatccgggaggtgaggggcgcttctgcccggccgcccctactgggaagtgaggagcccctctgcccggccaggaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttggaaaaaaaaaaaaaaaaagaaataagatgctggctgggggcggtggctcatgcctgtgatccgaaaactttgtgaggccaaggcgggaggatcgcttgagcccaggggttcaatataagccttggcaacatagcaagaccccgtctctacttctcagaaagaaaacaaaagaaataagatgccatggaagggatggcaataagcgttttccataaacaacccgagagagagaaacagaaaacgctgtccaagctaagccttgcttccacactgggctttgcagattttccaatgagccaccaacgaggtggttaaaacatcagagactgcatccgattccccaagacaccaaggctctcgggatgggaacaggcaaatcgtcgtcgttctttgctgagcctgcgggctgcggtcaccagaacgaatctgggcccagcaggtgccaagggctcgacctcccgccttgcatccggcaggccgcacacacccctcggaagtcggcgagatcgctgaggcaaagcgactccagggcgcagagacccacacgcgacgctctaaaggaagtgacctttaggggctgttactctcagaccaggcccagcagcacccggcgcatttacgtcggatctgacccctgcaagcaccggcgcgaccgcgctagcggctgggaacacgcgacggtcccgcccactgcgacctgactcggccaatcccgggtggcgcatgctgcggccgccggaagtggacctacgtcatgcaggtcagtcggtaggtttccggcgcccagcgccccgtgggagttgtgtctggtggcccacgctgggggggggctcttcacactggtgggcgcagaggcgaagccgttcccagggcccctcacagaactcggtgtcagaatttccccccttgcaccagcgccgcctcaaatgtcagggctcgcccactcttctccggtctcgccgacataaccttttgggggctccagaggggaaatttgccgtttctgccggaccgctctagagcgtgcctgaacccggcctttatgggatgttgacagctacgtttattcagtgccccagaggccttctttatgcccagtaactacaatttaaattccttctctgcttcattttgtagtcgtctggtgaatttgacgtgagaaataagattaaaataggaataagaaattagttgaaatcacattgtagagttctgcaaatgtaaaatattaatttatagcaataaagcaggctgtcaaataacagaggatgaaagcaggataatacttggtcagaacctgctgtatgccaggggctgtgacagatgctggggattcagcaaccaccaagacaagaaggttcttccggcgttcacaggactaggggaagacacaataaataactaaaggcaaaatgctagaatgatgcgctctctctcaagatgaaatatagaacatgatttattttttatttttattttattttattttgagacggagtttcgctcttgttgcccaggctggagtgcaatggtgcgatctaggctcactgctacctccgcttcccgggttcaagcgattctcctgcttcagcctcccgaaagtagctgggattacaggtgcctgccactacgcccggctaatttttttgtatttttagtagagacagggtttccccatgttggccagggtggtctggaactcctaacctcaggtgatccacccgcctcggcttcccaaagtgctgggattacaggtgtgagccactgcgcccagccgagaacgatttattttagagtgtttacttaatgagatgcctaatgtaagagtgacccatggaaaaataataacttggcagcagttttttttgccgctaagatcaggacaattctgaggggagttttgttttggaacgatgaccagatggccatgggtggctattactaacactgtcaatgccatttctctgttattgccttgtgacctccacaggcagagcaatatttcatcattaaaagttgcaactgctatgagaagctacgttccttgaaaacagagtttttggccaggaatagttgcttatgcctgtagttccagctacttgggaggctgaggcaggaggatcccttaagcccaggaggtggaggccaacctgggcaacatagccaggcccggtctctaaaaatgaaataaaaccggcagtttcttccttcgtacctcccgcagtgcataaagagttgtcaaatgttgagttaaaaaggtagtggataggatggggcggttctgcctggaaattggagactgaactaggaagtgtcttcgttgtcagtactacagcagtattttttggtaaatggtttaattttttggttttatcttatgaatgtgtgatgagaaatatgcatgaactatagagtgtcttaagtgtaactgacttttaatattgacagtatatggtgggtagagtgtgaaatttagcatcagaaatctgaatttgaccaagactgcaggaccttatacagtcatttcacccttctggacctcaaccttcacatccgtggaaggaaaattgtaacacctgccaggaagtcaatatataaggtctaaagatgataaatgagaaataaaatattagcatactgtttcaaaatactgatacactaccagaagaaacagttgaaagagttgaaaatacttgcttctggggagcagggctgaggggaaggactgagttagagggctgctgctgcatggattcactactgctctgtagcaaaacctggctgctacagttcaccgttgggttgtagtaactctgtttcaggttgttagttgtgcaggttggctagggccgctctgttccacatgttcattctgaaacccaggttgagggaacagcagcaacttgcctgggggaaaagctcttcctacagcaattcaaaagtagaagagcacaacctaataatcagggcagacttttcaaggctttgttacaggtgtctgttaacattccatggaccaaaacaaggccaaacccaaaatcaagggacaggaagtagactccacccatgcaggtggaaggggagtgactatttctgaaaaataatccaatctgccgcaagtaatacttgactttttaaaactgtgcagtgtattcacttggtaagaattaatgctgactgtggtccatttcaggtcttgatggtgatgcgtatgtctcaggaatgttaactccagttcattctctctggctctcactgctg

SEQ ID NO: 312 - DNA, 13283 bp, Homo sapiens
  Regulatory Element of TNFRSF9
cttttaaaagtaacagcgtgttgtttaaggaggattcatttgtaaagcttaatatatgacattgctggagttcaaaatgaaggcctcagaagcaagtttttctctaaacttctcctgccctcctgtctctggcccctcattctccccgcaaaggctaccatgaaacatgaatcccccttccccaaggtgggtcacagaaaccagaacccctttttcccaaagccagccttaaaacctgagaagattactctaactccccctgcccgcccaccctgcctttctttgtaaaaaccggccataaagaaattctctgacctaccttgtttggctgtaggtcaccaggctcccattccagagagggtcctgcctcacacccagaaggaatgaaggctgcacagagaggccaagaaggccctacacagaacccccagggtctccccactcagtccactagcatcagatcagagcctttttgtccaatcctatctctacatggctgtccatactctgttgaacctaagcataaaaattgacgtctgtatctttgggtcttcattctgaaggctcccatgtaacataaaactatgatcaaataaatttgtatgccttttctcctattaatttggcttttgtcagttgattttcaggagctctttagagagcaaagaagaaattttccactggcccccaacagaatattttttgtttgtttgtttttgggatttttttcagacagggacttgctctgtctcccaggctggagtgcagtggcacaatcatggttcactcaacctgttggcagcctcaacctcctgggctcaagtgatcctcctgcctcagcctcccaagtagctgggactacaggcgtgagccactacgccaggctaatttttttaaattatattctgtggtgacataggcctcattaaccctcattaacttgcccaggctagtcgtgaatgcctgggctcaagcgatcctcccatctcggtgtgagccaccgtgactgcctctacagaatgccttacatcaaagggaagcccaggctcatttcaacttcccagtacttttgtagtgaataaggaggaattgggacccaagacggctatcagaccgcaaaggtgcacagcgggtgtcccccacattacacagtttgcttcgattgccttcttgggacctcttagaaccagggtctatatttggaaacagcacaattgcaggatgtgtgatcataattgcactgaattataagcatttcttgcatcagaaattctaaattacttaatagaagtgagtgttattgtactgagcatggctaaatacgttactcatgtttattaaatgagaatccaagaagagcatttactgggtgcttgatttgtgtgaggcactgggctaaataccttattcatttattctttgaaacagccccacgtaattttacagatgaagaaaccagggtttagaggattatgtaaactgcctaaggaccctctgctacgaaaaggtggtggctgcaatccaacctcaaaattactgggtccaaagcccgtgaagttaaccctgacactaaatggcctcaaaattgtttaattaagtatatcaggccaggcacagtggctcacccctgtcatcccagcactttgggaggcctaggcagtggatcacctgaggtcaggagttcgagaccagcctggccaacatggcgaaaccccgtctctactaaaaatacaaaaattagcgggagtggtggcaggtgcctgtaatcccagctactcgggaggctgaggcaggagaatcgcttgaacccaggaggcggaggttacagtgagccaagatcgcgccactgcactccagcctgggcgacagagtgagactctgtctcaaaaaaaaaaaaaaaaatcagatggaagacttttctgtggattctggcttgttatataccttaaataaacaacagtagtgaaaagaaatctttaagaactatcatccagggatttctttggtatgccagcatgtgctggtcaaataccatcttatctccctgatctgggtttgacaggctcatctctttctcactgtggtcacactgttttatttctgtgaagaaatatgaacctgaaagagggaattcttcaagatagatccctagtggctaactgagcctaaatttaaaatagagccaaatggctaaaatagttagccatttgctaactagaagtcacacaggtactctgagattcctgaaaaccagcaccttcttaatgttgggacttttggagctcacctgcctccaccaaccagggctcagctgtatcgactaatgaggactcagcggcataaaccaatcaaaactaagcaagtttcagtctttcatttgcataaacagacctgattgggaacctgggcaggaactttataacacgcaaatcccccttttcttgttgtttttctttgagatgaaatctcactctgttgcccatgctggagtgcagtgtcatgatctcagctcactacaacctccacctcccaggttcaagtgattcttctgcctcaacctcctgagtagttgggactacaggtgtgtgtcaccatgcccggctaacttttttatatttttagtagagacggtgtttcaccatgttggccaggctagtctcgaactcccaacttccggtgatccctctggctctgcctgtgacctcatgtgccctccactggggcccccacagagtccagagctgtccctggaacagctctcctccctccccaagctccatcccaggacttctcactctgccctgccaggagccagcagtcccctctgcagtattcctgtctccattcacttgtaaccacgtacccccatttttctaagaaatcgtttattttttttttctctctctctctccttttctcattcccctggttccccacttcctactttgccctttaaaatgcaagtatagctttttctttttttttttttttgtttttatagagggcaagttcctctaactctgtgctccaagactctcctcaagagctaatagtcgatttacaaaccaaagcatgcatgcctgctacggaactcccaccctccaggaggttgcctcggaactccctcccaccaagagacgtgagagatatgggactctgtcctacctggggagttttcggcctagtcctgcccatgaaggcaccggcagtctctagctcagccgcccagtagataaagcactagatctagcctgcagaccacgcccggccctgctcacttcctcccctgccttttcaacgtgccgtctttctgctccaaaggtgaagcgggacacttaagataggacacctgtatttcttcccctaagctagctttgggataaatcactgtcttcataccacacctcgctcttgttaatcggagtctgcaagtgagtgactaacccgcgtttcagttacaccctccctgcagtcagggagcactttctaaaaggcaaatccaatcaaatctcttcactggcttcctagtgaccacatgttaaaatcaaagctgctttttttttgttttttttttgttgttgtttaagagacagaatctcactatgttgcccaggctggttttgaactccagacctcaagggatcctgctactttggcttcccaaaatgctgggattacagggtgagccactgcttctaactaaaatccgagggtttttttttttgtttgtttttctttttttttctggagtgcagtggcgcgatctcggctcactacaagctccgcctcccgggttaactccgttctcctgcctcagcctcccgaatagctggggctacaggcctccgccacgacgcccggctcattttttgtattttttagtagagacggggtttcaccgtcttagccaggatggtctctatctcctgaccttgtgatccgcccgcctcggcctccccaagtgctgggattacaggtgtgagccactgcacccggccaaaatctgagtttcttatataacttataaaatctggctctctggtccctgctcaccctgtggcttccttcccctctcctcaatcccagccccaactctccctcccatgtgcctgggcccatggctccttctgagaagcacactgcctggacaggcatcgcttcctctgcatcccgctttccctcccttccctctcccccctcccccctccctcccccgcccccttccctcccccttccccctccccgtcccccaactccatccctccctcccctgcctcccagcggagctccctggtgcacagctgccccttccccacatcccccccacccgccaccgtgagcaccaggagggcagctgctctcactccccttttgccgtccatccatggtgcttggtgcctggtggcgttgtgttgaatgaagattcctcttagagaaagcatcttgtaccccaatgtggatcttaacacgttggacatgtcattcccctcgaatgaaagttcccaggcaggaagtgagttttaccttatcatgtggatgtgtggatcttatcaggttagacatgtcattcccctagaatgaaagttccaggtgggaagtgagttttatccttgtgcttgtgtcctgatgtggttcctggtgcagagtagacacctggatggctgctagttcagtgaaggagtcatttggatccaatagtcagcatcttcaatgaatgtgtcagaatctgcctcttcaatgaatttggaaaagttgtttgaaaggcttcaatggcttagtgaattttaaatacagctatctgaatcaatattgatgtaacaacagttttttcttttttttgagacaaggtctcactttgtcatccaggttgaagggcagtggtgcattcatggcttactgcagcctcgacctcctgggctcaaatgatcctcccacctcagccccccaagtagctggaactacaggcatgcaccaccatgcctagctaattttttgtatttttggtagagatggggttttaccatgttgcccaagctgggaaaacagcatttttttttttttttttttttttttcctgagacagagtctcactctgtctctcgggctggagtgcagtggtgtgatctcagctcactgccacctccacctcccaggcttaagtgattcttgtgcctcaacctcccgagtagctggtattacaggcgtgtgccaccatgcctggctaatttttgtatttttagtagagatgaggtttcactatgttggccaggctggtcttgaactcttggcctcatgtgatccacccgcctcagcctcccaaagtgctgggattacaggtgtgagccactgtgactggccaaaaacagcattcttcttttttttttttttttgagacagagtctcgctctgtcgcccagactggagtgcagtggtgggatcttggctcactgcaacctccgtctcccaagttcaagtgattttcctgcctcagcctcccaagtagctgggattacaggtgcatgccaccacgcccggctaatttttgtattatttagtagaggcagggtttcaccatattggtcaggctggtcttgaactcctgacctctggtgatccaccccccttggcctccccaagtgctgggattacaggtgtgagccactgcacccgatcaacagcatccatttttatgtaactaataagtcaattgttgaaagcaaaaggaatctcatactggaaatctttagcatccttcggcactaaaagccaaagtttacaaagaatggcaccttatttcatgattaccctttatgatatgatgttgcaacagttataaaaagctttttaaaataaggtctttttttcttattctttttttcctgtgaacatcatagttttgtgttttattagatagtcttttaaataaaaacgttgataaagatcactctccaagtcctaccacacacagggcacatgtaacctgccctagctgcggtgggcacctctcacccacagatggaaacatcttcctgtgggggaagatgcccactttatagtcatccgcccctcacatcaaaactttccgtcagagtgatatcttccactaaagaaaaaaaattaaaactttcttctgaaaaaaacctgagcttgtttttagcatttagaaaatgatttataatttgtgtatccctaaatgtgctaatttatttttaatcatagaaatttacatttatttctattaaacctaattatggaactttctaaattaaacccagaaggggatcattttattctgtctcaatgttccttccttattaattgtcatttagggggagcaatgactcacatgccaagttcctgtgtttttcatttatagcttttgcacatgataccagaataggctatgataaaaatatcacagtctgtatcataaacatagcctcctttcttcacagaataaactgtggattttcggtgtgtaacctaggacacatgagagcctcgctccattatcttggataccccaaccctgtggggcatgaccagtctctttctgtttgtggatagtcagcagtaggtaattaaacaccatgtgtccaaagccaagaggagaaatcactttagaacttacagcatcatgattcagaaagacaaaaatattcgcacctagctttgttcctgaaatggcaccagtatacttcctaagctttgctttgcctactatttggcaagaattgtacagccaataattgttctcttattcttattggaacaccagatgactcaattctgtaaaattatcaactctccctaaattgacctgtagatttaatgaaattccaatccaaatcttttcaaattcagcttctaaaatttatattgaataataaagaaccaagaataaccaagacatctcttttcttttttttcctgagacagagtttcgctctgtcacccaggctggagtgcaatggtacgatctcggctcactgcaacctccgccccccgggttcaagcaattctccggcctcagcctcccaaatagctgggattacaggcacatgccaccatgcctgactaatttttgtattttttagtagagatggggtttcaccatgttggccaggctgtctcaaaactcctgacctcaggtgatccatccgcgtcggcctcccaaagtgctgggattacaggcgtgagccaccgtgcctgacctagctaagacacttctgaagtagaaaaagaaggtggagggagatgtcctaccggatatcgagagctgttacaaagctattgtaataaacacagtgtgatactggcacaggatagacaaattgacaatggaacagaacagggagcccagaagcagacccatggccctatggaaacttgatggatggtaggtgagattgcagacccgcaggagaaagacgacgtattgaatacatggcgcagggaccagtggttacctacatgcaagacatggaattggatcactacctcccaacaggcacaaaagccagttcctgatacattagacttcaagatgaaagacaaaacttaaaacttttggaataaaatgtgggcaaacctctttatagtattgggcagaaaaggatttctttagccaggcaagaaaaaatgttaaccatatgagaaaacagttataaatttaaccaaatcaaatgaagaactttttgcttattaccagaaagacaaagaaagacaccattaattagagaaaaacaggaggggcgcggtggctcatgtctgcaattccagcactttggaaggctgaggtgggaggatcacttgagctcaggagttcaagaccagcctgggcaacataatgaaacctcagaaacctcacctctgctaaaaataaaaataaaaaagaattttataaaaaattttaaaaagggaaaaataaattacaaaggatatatatatatatatatatagatatagatagatagatagatagataggcagaatttcactcttgtcacccagtctggagtgcaatggcacaatcttggctcgctgcaacctctgcctcctgggttcaagcgattcttctgccacagcctctggagcagctggggttacaggcacccgccaccatacccagctaagttttgtacatgtttagtagagatggggtttcactgtgttggccaggctgatcttgaactcttgacctcagatgatccacccacctcagccccgcaaagtgctgggattacaggtgtgagctaccgtgcctggccacaaagaagatattttttaacacatataactgaccaaagattattatctagaatacataaagaccttttaggaatcaggacaaacaaccacatttgggtttgtttgtttctgagaaaaggtttttctctgttgcccaggctgaagtgtagtgatgcggtcccagctcactgcaacctctgcctcccaggctcaaagcgaacctactgagtagctgggacttcaggtgcacaccaccacacccggctaatttttgtattttttgtaaagacagggtttcgccatgttgccaaggctggtctcgaactcctgggctcaagcgatctgcccaccttggcctcccaaagagctgggactacaggcatgagccactgcacccggccccaagtttttttgcaaatgggcaaaaaagcatgagcaagcattttatttaaaaaaataaacacaaatggtatataaatatttgacaaggtgctcatcagtaaccaagcaaatgcaaactaagaccacagtgagatctcattctatacccactggcttggcaaaattaagggcacctgatagtaccagagggtagcaaggatgtggatcaatgggatacttacatgacacttatatgactgacgggagtacattagaacagccactttgaaaagcaatttggtactgcagtagactattgttcagaaatatcttctcctcacccctatttacagaatatacttttctgccctattgatgcctggcttggctgcaggatttgctctaaaggttatagtagaaccaactaaataggagcagaagtgacagatacccatttgccatgcgatggccaatgttccaaatagaagctgctccctccacctaaatcccagagtaaaataacatgggacagaggcacgcaagcttgcaataggcatgtcatacaaaagtgtaagaaatggccaggcatggtggctcatgcctgtaatcccagcactttgggaggcagaggtgggcagatcacctgaggtcaggagtttgagaccagcctggacaacatggtgaaaccccgtctctactaaaaatataaaaattagccaggcgtggtggcacatacctgtagtcccagctacttaggaggctgaggcagggagatcacttgaaactgggaggcggtgatccaagattgtaccactgtactccagcctgggagacagagtgagacactgtctcaaaaaaaaataaaatgaataaaatttaaaaagctatccttagatcataagccaaacaatggcaggcatgccaggtttgcacctgtaatcccagctacttgggagactgaggcgggtggatcacttgagcccaggagtttaaggctaaagtgtgctatgattgtgcctgtgaatagccactccattccagcctgggcaacagagcaagactgtctcaagcaaaccaacagacaaacaaaggcaaatggtgcaccaggtttggccatgggagtttggcggcccccactctagtgctgtggtaggacaatgagctcacaggtgttaattttctcactgtacttcatacctatcatatgcagttcatttattggctttggtataaaatattatgttaaaagttaagaatttttagaatgtaacctggcttaaaagggagcaggacaaaggcagaaggtgtgaggatggagaagaccataggatatacagacacttgaactctttccaaaacttcctccaggcctgaggttttttgtccttgaccctaaactcaggcactctgctcatactcccccctgacggtggagcatgtcgtgttacatgacagaacccacggaaactttagtcgggtacttactgcacctcgtggcttattgtcatatgtcatattagcaccaaaaaacaaacctgcattgattttgattataattatagttggaccactggactatgtaattgaatttaaactataattttctttggatttcaaaaaaactagctcaaacctgttaagtggtatctagaaaatgcttttttttttttttttttatcaccagctctgtcctcatctgtctgttctgttaaaagtggtgcattattttggccgggcctggcagttcatgtctgtaatcccagcactttgggaggccaaagtgaacctaggagtttgagaccagcctgtacaacatggtgaaatgccatctttaccaaacaaaaaacaaaaaagttagtcaggtgtggtggcccttccttgtagttccagctactcaggagactgaggcaggaggatcacttgagctcccagaggtcaaggctgcagagagccatggtggtgccactgcactccagcctgggtgacagagtgagaccctgtcaaaaaaaaaaaaaaagtggtgcatttttaaaggccaactcattggcatttagaaaagaacgtgtgttgggggaatcctgggtattatgtaggatggtgttcttgcttttgaaagctgtgatagcggatgactcatatttccttgcttcttttcaagaaagtcccaacagccctattgacttccatttcacagttcacatcctccttcttcttcttctggaaatcggcagctacagccatcttcctcttgagtagtttgtactggtctcataaatgctaaaaaaaaaattttaagatacgtatattttgttgtctatttgaatcatttaacacttattttccataaattatagctgcagaacatctctaagcagcaaacattctcccctttaattttaacaaactcagccaggcgtggtggctcatgcctgtaaccccagcactttggaaggccgaggtgggcagatcacttgaggtcaggagttcaagaccagcgtggccaacatagcaaaaccccatccctactaaaaatacaaaaattagccgggcgtggtggcaggtgcctgtaatcccagctactcaggaggctgaggcaggacaattgcttgaacccaggagacagagattgcagtgacttgagatggcgccattgcactccagcctgggtgacaacagcgaaactctgtctcaaaaaacaaaacaaaacaaaacaaaacaaaacaaaacaaaacaaaaacaggccgggcgcagtggctcatgcctgtaatcccagcactttgggaggctgaggccggtggatcacaaggtcaggagttcaagaccagcctggccaagatggtgaaaccccgtctctactaaaaataccaaaaaaattagctgggcgtggtggtgggcgcctgtaatcccagctactcgggaggctgaggcagagaatcgcctgaacctgggaggtggaggttgcagtgagctgagattgcgccactgcactccagcctgggtgacagagtgagactccatctaaaaaaaattataataataatagtaataataattttaacaaactcatccacaagagaggtaacagcaaggatgaacttcctctagagattatttgaaatttgtttcctcttaccaaatatttgtattggtctttaagaactattttctttattttctacattagctaaaaaagcatgaatcttaagcatgaatcactaaaccataaaatattagccatatcccaatcatagctctagtttcaattcagcagcacttattttcgtcttgagggttactgagattcgagatccgatggtttccttggaatgcagtgttatgactccaggattgtgaaggtatccccactgcttccatctgttaggaaccaagaaccgatctgtgcgtgagctgccaggctttcttttacatgttagtgaagtatttgtgttactgctccgcaaatttcaatcctaagcagatatttatttacagactggcaaggcaaaaagtcctaccccgatttcatatgcttgttgctataaaaaataaccacaccatctcctagaacttatgaaaaactggcaagatgttcagaaataccaacgggatgtcttttgaaattgttcccaggttgaatttcaaaatggagatctcttctggaaagattgagatgtcatgttttccgtatttgtcctgctgagtactgctgaaaacctctcagaaaggcagagagaggaaggccaattgggtcaggatctccagacccaagaaacaacatggcaatgggtttctttctgcctcatttccctctgactgggaactagagaagcagcactctaaaaatgccaatagcgtggacaaaacaaagcaaaaaccaagaagaggccaggcgtggtgactcacatctgtaatcccagcactttgggaagccaaagcaagcagatcatctgaggtcaggatttcgagaccagcctggccaacatggcgaaaccctgtctctactaaaaacacaaaaattagctgggcatggtggcgctcacctgtaatcttagctattcgggagtctgaggcaggacaatggcttaaacccaggaggcagaggttgcagagagctgagattacaccactgcactccagcctgggcaacagagcaagactccatctcaaaaaaacacataaaaaactaagaggagcttgtactctctagttatgagaccaggaaaggggcagcatagcaagactacaaacttcttttttttttcttttttttttttgagatggagtctcactctgttgcccaggctggagtgcaatggcgtgatctcagctcactgcaacctccgcctcttgggttcaagcggttctcttgcctcagtctcctgagtagctgggactacaggtgcccgccaccaggcccggctaatttttgtgtttttagtagagatggggtttcaccatattggccaggctggtctcaaactcctgaccttatgatccgcccatctgggcctcccaaagtgctgggattacaggcgtgagccaccacacctggtccaaaaacttctagacaataaccactcaattctaacaaaacaccacaaaaaacaccgtggctccgcctgcaagcccaccaggaaggactgagtagagag

SEQ ID NO: 313 - DNA, 5970 bp, Homo sapiens
  cDNA TNFRSF9-201
caaggagggatcccacagatgtcacagggctgtcacagagctgtggtgggaatttcccatgagaccccgcccctggctgagtcaccgcactcctgtgtttgacctgaagtcctctcgagctgcagaagcctgaagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatgataggtatgaagtacagtgagaaaattaacacctgtgagctcattgtcctaccacagcactagagtgggggccgccaaactcccatggccaaacctggtgcaccatttgcctttgtttgtctgttggtttgcttgagacagtcttgctctgttgcccaggctggaatggagtggctattcacaggcacaatcatagcacactttagccttaaactcctgggctcaagtgatccacccgcctcagtctcccaagtagctgggattacaggtgcaaacctggcatgcctgccattgtttggcttatgatctaaggatagctttttaaattttattcattttatttttttttgagacagtgtctcactctgtctcccaggctggagtacagtggtacaatcttggatcaccgcctcccagtttcaagtgatctccctgcctcagcctcctaagtagctgggactacaggtatgtgccaccacgcctggctaatttttatatttttagtagagacggggtttcaccatgttgtccaggctggtctcaaactcctgacctcaggtgatctgcccacctctgcctcccaaagtgctgggattacaggcatgagccaccatgcctggccatttcttacacttttgtatgacatgcctattgcaagcttgcgtgcctctgtcccatgttattttactctgggatttaggtggagggagcagcttctatttggaacattggccatcgcatggcaaatgggtatctgtcacttctgctcctatttagttggttctactataacctttagagcaaatcctgcagccaagccaggcatcaatagggcagaaaagtatattctgtaaataggggtgaggagaagatatttctgaacaatagtctactgcagtaccaaattgcttttcaaagtggctgttctaatgtactcccgtcagtcatataagtgtcatgtaagtatcccattgatccacatccttgctaccctctggtactatcaggtgcccttaattttgccaagccagtgggtatagaatgagatctcactgtggtcttagtttgcatttgcttggttactgatgagcaccttgtcaaatatttatataccatttgtgtttatttttttaaataaaatgcttgctcatgcttttttgcccatttgcaaaaaaacttggggccgggtgcagtggctcatgcctgtagtcccagctctttgggaggccaaggtgggcagatcgcttgagcccaggagttcgagaccagccttggcaacatggcgaaaccctgtctttacaaaaaatacaaaaattagccgggtgtggtggtgtgcacctgaagtcccagctactcagtaggttcgctttgagcctgggaggcagaggttgcagtgagctgggaccgcatcactacacttcagcctgggcaacagagaaaaaccttttctcagaaacaaacaaacccaaatgtggttgtttgtcctgattcctaaaaggtctttatgtattctagataataatctttggtcagttatatgtgttaaaaaatatcttctttgtggccaggcacggtagctcacacctgtaatcccagcactttgcggggctgaggtgggtggatcatctgaggtcaagagttcaagatcagcctggccaacacagtgaaaccccatctctactaaacatgtacaaaacttagctgggtatggtggcgggtgcctgtaaccccagctgctccagaggctgtggcagaagaatcgcttgaacccaggaggcagaggttgcagcgagccaagattgtgccattgcactccagactgggtgacaagagtgaaattctgcctatctatctatctatctatctatatctatatatatatatatatatatcctttgtaatttatttttccctttttaaaattttttataaaattcttttttatttttatttttagcagaggtgaggtttctgaggtttcattatgttgcccaggctggtcttgaactcctgagctcaagtgatcctcccacctcagccttccaaagtgctggaattgcagacatgagccaccgcgcccctcctgtttttctctaattaatggtgtctttctttgtctttctggtaataagcaaaaagttcttcatttgatttggttaaatttataactgttttctcatatggttaacattttttcttgcctggctaaagaaatccttttctgcccaatactataaagaggtttgcccacattttattccaaaagttttaagttttgtctttcatcttgaagtctaatgtatcaggaactggcttttgtgcctgttgggaggtagtgatccaattccatgtcttgcatgtaggtaaccactggtccctgcgccatgtattcaatacgtcgtctttctcctgcgggtctgcaatctcacctaccatccatcaagtttccatagggccatgggtctgcttctgggctccctgttctgttccattgtcaatttgtctatcctgtgccagtatcacactgtgtttattacaatagctttgtaacagctctcgatatccggtaggacatctccctccaccttctttttctacttcagaagtgtcttagctaggtcaggcacggtggctcacgcctgtaatcccagcactttgggaggccgacgcggatggatcacctgaggtcaggagttttgagacagcctggccaacatggtgaaaccccatctctactaaaaaatacaaaaattagtcaggcatggtggcatgtgcctgtaatcccagctatttgggaggctgaggccggagaattgcttgaacccggggggcggaggttgcagtgagccgagatcgtaccattgcactccagcctgggtgacagagcgaaactctgtctcaggaaaaaaaagaaaagagatgtcttggttattcttggttctttattattcaatataaattttagaagctgaatttgaaaagatttggattggaatttcattaaatctacaggtcaatttagggagagttgataattttacagaattgagtcatctggtgttccaataagaataagagaacaattattggctgtacaattcttgccaaatagtaggcaaagcaaagcttaggaagtatactggtgccatttcaggaacaaagctaggtgcgaatatttttgtctttctgaatcatgatgctgtaagttctaaagtgatttctcctcttggctttggacacatggtgtttaattacctactgctgactatccacaaacagaaagagactggtcatgccccacagggttggggtatccaagataatggagcgaggctctcatgtgtcctaggttacacaccgaaaatccacagtttattctgtgaagaaaggaggctatgtttatgatacagactgtgatatttttatcatagcctattctggtatcatgtgcaaaagctataaatgaaaaacacaggaacttggcatgtgagtcattgctccccctaaatgacaattaataaggaaggaacattgagacagaataaaatgatccccttctgggtttaatttagaaagttccataattaggtttaatagaaataaatgtaaatttctatgattaaaaataaattagcacatttagggatacacaaattataaatcattttctaaatgctaaaaacaagctcaggtttttttcagaagaaagttttaattttttttctttagtggaagatatcactctgacggaaagttttgatgtgaggggcggatgactataaagtgggcatcttcccccacaggaagatgtttccatctgtgggtgagaggtgcccaccgcagctagggcaggttacatgtgccctgtgtgtggtaggacttggagagtgatctttatcaacgtttttatttaaaagactatctaataaaacacaaaactatgatgttcacagg

SEQ ID NO: 314 - DNA, 1923 bp, Homo sapiens
  cDNA TNFRSF9-001
gtgtttgacctgaagtcctctcgagctgcagaagcctgaagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatga

SEQ ID NO: 315 - DNA, 445 bp, Homo sapiens
  cDNA TNFRSF9-003
gagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaacatggaagcagtggggataccttcacaatcctggagtcataacactgcattccaaggaaaccatcggatctcgaatctcagtaaccctcaagacgaaaataagtgctgctgaattgaaactagagctatgattgggatatggctaatattttatggtttagtgattcatgcttaagattcatgcttttttagctaatgtagaaaataaagaaaatagttctta

SEQ ID NO: 316 - DNA, 584 bp, Homo sapiens
  cDNA TNFRSF9-002
tcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaacatcagagtggctgacgaatggaatcatgattcacaagaaaagtattgactattttctcggacttagctgaattctgtctttggaaagtggcttttttaaaaagctgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaacgtaagattaacataatcatattacagctctggcaa

SEQ ID NO: 317 - DNA, 5045 bp, Homo sapiens
  Coding Sequence of the TNFRSF25 Gene
tttttgttttgttttgttttctttcacagatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataagtaaccgtacttagggcttctgcaagggccaccagagcgcctaggtggcaagtgggcgccgtgtcacgggccgcgctgcaggcggctgcgcaagtcttccacgcagccgtccagccccatgcgctccagggccgcgtaaacggctccgaggcccgcgggctgctgctggcgccagcgcttgagcatctcgtactgctggtctcggaagcggccgatctccacctccacggcttcgatctctgcctcgcgcagccccagcgtgcgcacgaactccttccagcgccgcgctgggaccgcgtccatcacgtcgtagagctgcgggcccggctgcagcatcatggctggcgagccggctggggactctggcgagagtgtgggcgcagcagcggggcctggggcagggccagagagagccaattggggtacgtgggccgcggtcgggaggcagagtcaggggcgttcgtgcgggtaccccagggctgaagcccgctggatccggtgggtcagggcatagggcggactccgtcagttagggggcagaaagggaacacgttgtgaaaccacaacttcccaccgcagacaggagaatggggtcaaggcctcaggccactgatgtcccttaccaagagctctgctgggcaactggtcccaggaccatgtcacctgcgggcagagcgcctcctgggtctcggggtagccaggggtccagctgttacccaccaactggacggtgcagatcttctcactgctgtcaggaggtgctagaagggtgtgggcgctgtccaagggtgacagatgggtggcctggaagccaagaggggccccaggtcagccctgcttgccaagtaaggccccttacccgcagtgcctctccaggaggggacagtccctggttcagtcagcagacacccccgcaatgacacctcccacagttggccctgctctcactgtagcccagcagaactcttgcttctgccttgagtcccctgcccccgcctccttcctcttgtcccccagcaccatggggctctccttccattgaactgttagctcctgtgtacgaatctgaactccagctgactgagcaccccttgagggcaggcactgtgctggtctcatccactgatgactctgctcccaacacctctgtccactagggctacccggtgctggccgcgtgccaagctccagggatcatagtaaggcttgatcttccagctccagaaggcagcccagaatcacacagtgaggttcttaccggtggtggggtcagagcctccatcccagcttcatctgctgacagacacagagagattgcggtcagccaccaggcaagcctcctggacctgggtgctggtacagctcctctagggttcctctgcaccccacactccctgcctcagtttccccttctgtatcagggttgagtagactctgggctacccatcctgaccccaggcttctgggtgcgtgtgtgggtgtgtgtacttaccagtaaccaggggcttgtgaggccagcagtggcggtatgtgtaggtcagggtggccccaagcaggagggggaccacaaggccagccaggagcacctggacccagaacactgaaagcagctggtgggtgttgggtggttgcccccctcctcacccgcctcccctcggtccatcccagttctcccactcgcattcccagcacaccacctactctgcctccagccacagacagcggcacagcgctctggacagctccccagggtgctcctgcaagggacgggggtggcctgagggatgagggggtgcatgccaggaggggctccctaagactgcccagcatctgctccatcctagagacccttccctccccaggcctctcactctacccaagaatgttcctgtcattgtgtccctggtaacaaccacagacactattcactgagcttcttctagactacatgaagagtcactagaatgtcaaccccaaaaggacagggattttgcctattttgtcccctgttgcatccccagcacctagaacagtgtgtagaacatagcagatattcaataaagacttgaatggaggccgggcgcggtggctcatgcctgtaatcccagcactttgggaggccaaggcgggtggatcacgaggtcaggtgatcaagaccatcttggctaacacggtgaaaccccgtctctactaaaaatacaaaaaattagccgggggtggtggtgggctcctgtagtcccagctacttgggaggctgaggcaggagaatcacttgaacccaggcagcagaggttgtagtgagccaagatcgtgccactgcactccagcctgggtgacagagcaagtctccatctcaaaaaaaaaaaaaaaaaaaaaaaaaaaagacttgaatagctacagaaagtcccttacctctgatcaaaggcctgtgaattagctgctaacatcccatgttgagaaagggacaccacacatcagagacgcgaattctctgcacttgcccaagatcccctagagaactagcagcacagtcctgactctcagccctttgtatttatttatttaatagatttaatatttaatatttaatagatttaatatttatttatttatttaataggtctcgctctgttgcccaggctgaagtgcagtggcacgatcatagctcactgcagcctcaacctccttcagcccaagttttaaagctatatcaatgtgactctctgtgtaagtgacaaatcatctgtaatatctggctaggatcgctggggggaatgctggctgaaagtgaaggcaaatacccttatgtatctggctaaggcggatccagattgctcttttgccatctaagtttgcctgaagtggggcccacccatcacagggccaaggctccctcctccctatcccctcttcctattcctgaaccagcagcacctgccccaccccaggcccctgctctgctcccagccgcccttccctccatcccacgacagctaggaattacgtggggcaggacacgcagccatcgccatgttcatagaagccaggcaggcaggtcccacagtcagtatctctgcgggaacctgcaatccaggagaggcatgcgtcaccatgggacaggagtgggtcaggcagggagaagggggtctgggagtagagagccctgggtgggggtactcacagagtagccgtgtgtggcggtgcagggccccgcagtctaggcatggttggcagtagaagggtgaactgctgacacattggctgacctggcactccacaaaccagcctggcttacagccacagcgggtgtcggccactgctgaacagttctccagcgccacctgggaggctggtgggggtgcagggagatggggagtggagagttagtcagggccaaaggctcccatggagaggcagaggcattatcccaagataatggagacagaaataggcgaaagacagacaggtacagggctaccctaaaaaagagagaagctcagagattaaggccgaccagaggccaaggcacatggagagatgggaaggtcaccaggaagagagaaggggcaagggcaccctgaaggaggatcagggtggagggttctggcaagggtgggtgcaggaccctcacaccccaagtttgggcccgagccagccacttccttcagaaaggcctgtccttaggaactccctgccaagcactgagaagcccctcaccctgctcatcacaggcctggcagcgggcacattcagaattatggtggttctcccaggccaagaaggtgtcttggggacacacaaggcaggtggagttgccgcagggctccgtgcaaggggccttcaggtagtgccctgtggaaccaggcaggggtcaggcaggcagaggggctgcccagcaacccccgacctgcttcccaccctgccctccctccctctttctctccagctccctacttctctgtcagcctacccctacctcccctgccagcctcctcttacctcccgggcctgcccgccacctctccagccctgcctgccccatgcctctcccacccctgtggccacttacccgctgggcagcctctgcaacaaaacagaccaatcttcttgtggaagtcaccggcacagtcacacctggggctacgagtgccgccctgggcccgggcccccagcagcaccaggaggagcgcctgggggacaggtgctgctgactctcagcgcagctgcccacgtggggcctctccctgctgcgtctcctccatttcagaggccccagcatttgcccacagagcagcccacttcccaggccccgggcagaaggggtgcccatgggtggagaggaaactaacttccttccccccgcgcacacaccaggcttcggagggggcgcttaccagcccctcacaagtttcccctccaccagagcaggaatccagcagcgcccccacccccacccatgctttctgttgggggagggacactgataatgctctgcctggggcccccagaccctcctgggaggggtttcctctcagtggaagggctacgccctggaggagcctttaacgagatcggaaagggcggccaacccagcccccagtgaggcttggagtggagacgcgcccggggccccttccttcaccgaggctcttgggacagggctcaaagctgcccctagcctcctgcgtctcaactcaccgccgccaccgccgcgcagccccgcggccgctgctccatagccctccgacgggcgcccaggggcttcccggctccgtgctctctgcccgtcgtggttccgccttcagccccgcgcccgcagggcccg

SEQ ID NO: 318 - DNA, 5505 bp, Homo sapiens
  Alternative Promoter of TNFRSF25
cacgcccggctaatttttgtatttttagtagaggccgggttttgccatgttggtcaggctggtctcgaactcctgacctcaggtgatccacccgcctcagcctcccaaagtgctgggatcacaggcgtaagccttcgcaccaggcctgcaaaaaaaattttttttaattagctgcagggggctgggcgcagtggctcatacctgtaatcccagcactttgggaggctgaagcgggtggatcacctgaggtcaggagttcaagaccagcctggccaacatggtgaaaccctgtctctactaaaaatataaaaattaggtggtcgtgatggcgcatgcctgtaatcccagctactcgggaggctgaggcagcagaatcacttgaatctggaaggcggaggttgcagtgagccaggatcacgccgttttgtactctagcctgggcaacagagtgagactccatttcaaaaaaaaaaaaaaattagctgggcgggctgggctcggtggctcacgcctgtaatcccagcactttgggaggcggaggcagaatgatcacctgaggtcaggagttcaagaccagcctgaccaacatggtgaaaccccgtctctactaaaaatacaaaaattagctgggcatggtggcacgctcctgtaatcccagctactcagaaggctgaggcaggaaaatcacttgaaactgggaggtggaggttgcagtgagccgagatcgtgccactgcactccagcctgggtgacagagcgagactctgtctcaattaaaaaaaaaaaaaatagctgggcgtagtggcacacatctgtggttccagctacttgggaggctgaggtgggaggattacgtgagcccaggaggtcgaggctgcagtgagccatgatctcaccactgcgctccaccctggcaacagagcgagaccctgactcaaataataataaaacttagtctttgaaatatcatgcacattttacacctgcaatccatcacaatttagaccagccacatttcaaatgttcagcagccacatgtgcttagtgactactctgtcaacaggcagatctaccctctatgttctaataacttgtctctaattctcagtccctctctcaattatatggtctctctgctccccagcagccccaccccagtcctcaatacttcatattgacagctcccccacaactcaagtcctggtcccagtaatcttgctgctgcacccagcaataccacctcctcacatggtgccacacagtgacccagcacctctgtttccagtaaaaccccagcccacaataatccagccttaacctcccactcacccagctcccctgtgctccagtaaccccattctgcccccaatctagcccctctgtcttcagcaaccgagccccagccctcagtaacccaccccttgcatgggtgacctggcctctgcctggtgcctggccccaccctttctgccagcctgggtatctggccccagacttcaccgggtctgcccccctccccactgcctcaggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagccccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactcactcgctgtggccgcgacttgctctctccttctcggggtaattgagccagagtggactcgggaggggcaggcttgggagctaaggccacactggactccaccatgggtgccagatcccggggtgacaagattcccgtccccttcgaatccctcgagaaaagtccagtccacttaacaccccagccccgcagaaacgccaagaagccgtttttgttttgttttgttttctttcacagatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataagtaaccgtacttagggcttctgcaagggccaccagagcgcctaggtggcaagtgggcgccgtgtcacgggccgcgctgcaggcggctgcgcaagtcttccacgcagccgtccagccccatgcgctccagggccgcgtaaacggctccgaggcccgcgggctgctgctggcgccagcgcttgagcatctcgtactgctggtctcggaagcggccgatctccacctccacggcttcgatctctgcctcgcgcagccccagcgtgcgcacgaactccttccagcgccgcgctgggaccgcgtccatcacgtcgtagagctgcgggcccggctgcagcatcatggctggcgagccggctggggactctggcgagagtgtgggcgcagcagcggggcctggggcagggccagagagagccaattggggtacgtgggccgcggtcgggaggcagagtcaggggcgttcgtgcgggtaccccagggctgaagcccgctggatccggtgggtcagggcatagggcggactccgtcagttagggggcagaaagggaacacgttgtgaaaccacaacttcccaccgcagacaggagaatggggtcaaggcctcaggccactgatgtcccttaccaagagctctgctgggcaactggtcccaggaccatgtcacctgcgggcagagcgcctcctgggtctcggggtagccaggggtccagctgttacccaccaactggacggtgcagatcttctcactgctgtcaggaggtgctagaagggtgtgggcgctgtccaagggtgacagatgggtggcctggaagccaagaggggccccaggtcagccctgcttgccaagtaaggccccttacccgcagtgcctctccaggaggggacagtccctggttcagtcagcagacacccccgcaatgacacctcccacagttggccctgctctcactgtagcccagcagaactcttgcttctgccttgagtcccctgcccccgcctccttcctcttgtcccccagcaccatggggctctccttccattgaactgttagctcctgtgtacgaatctgaactccagctgactgagcaccccttgagggcaggcactgtgctggtctcatccactgatgactctgctcccaacacctctgtccactagggctacccggtgctggccgcgtgccaagctccagggatcatagtaaggcttgatcttccagctccagaaggcagcccagaatcacacagtgaggttcttaccggtggtggggtcagagcctccatcccagcttcatctgctgacagacacagagagattgcggtcagccaccaggcaagcctcctggacctgggtgctggtacagctcctctagggttcctctgcaccccacactccctgcctcagtttccccttctgtatcagggttgagtagactctgggctacccatcctgaccccaggcttctgggtgcgtgtgtgggtgtgtgtacttaccagtaaccaggggcttgtgaggccagcagtggcggtatgtgtaggtcagggtggccccaagcaggagggggaccacaaggccagccaggagcacctggacccagaacactgaaagcagctggtgggtgttgggtggttgcccccctcctcacccgcctcccctcggtccatcccagttctcccactcgcattcccagcacaccacctactctgcctccagccacagacagcggcacagcgctctggacagctccccagggtgctcctgcaagggacgggggtggcctgagggatgagggggtgcatgccaggaggggctccctaagactgcccagcatctgctccatcctagagacccttccctccccaggcctctcactctacccaagaatgttcctgtcattgtgtccctggtaacaaccacagacactattcactgagcttcttctagactacatgaagagtcactagaatgtcaaccccaaaaggacagggattttgcctattttgtcccctgttgcatccccagcacctagaacagtgtgtagaacatagcagatattcaataaagacttgaatggaggccgggcgcggtggctcatgcctgtaatcccagcactttgggaggccaaggcgggtggatcacgaggtcaggtgatcaagaccatcttggctaacacggtgaaaccccgtctctactaaaaatacaaaaaattagccgggggtggtggtgggctcctgtagtcccagctacttgggaggctgaggcaggagaatcacttgaacccaggcagcagaggttgtagtgagccaagatcgtgccactgcactccagcctgggtgacagagcaagtctccatctcaaaaaaaaaaaaaaaaaaaaaaaaaaaagacttgaatagctacagaaagtcccttacctctgatcaaaggcctgtgaattagctgctaacatcccatgttgagaaagggacaccacacatcagagacgcgaattctctgcacttgcccaagatcccctagagaactagcagcacagtcctgactctcagccctttgtatttatttatttaatagatttaatatttaatatttaatagatttaatattta

SEQ ID NO: 319 - DNA, 3641 bp, Homo sapiens
  1st CpG Island of TNFRSF25
ctcacatggtgccacacagtgacccagcacctctgtttccagtaaaaccccagcccacaataatccagccttaacctcccactcacccagctcccctgtgctccagtaaccccattctgcccccaatctagcccctctgtcttcagcaaccgagccccagccctcagtaacccaccccttgcatgggtgacctggcctctgcctggtgcctggccccaccctttctgccagcctgggtatctggccccagacttcaccgggtctgcccccctccccactgcctcaggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagccccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactcactcgctgtggccgcgacttgctctctccttctcggggtaattgagccagagtggactcgggaggggcaggcttgggagctaaggccacactggactccaccatgggtgccagatcccggggtgacaagattcccgtccccttcgaatccctcgagaaaagtccagtccacttaacaccccagccccgcagaaacgccaagaagccgtttttgttttgttttgttttctttcacagatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataagtaaccgtacttagggcttctgcaagggccaccagagcgcctaggtggcaagtgggcgccgtgtcacgggccgcgctgcaggcggctgcgcaagtcttccacgcagccgtccagccccatgcgctccagggccgcgtaaacggctccgaggcccgcgggctgctgctggcgccagcgcttgagcatctcgtactgctggtctcggaagcggccgatctccacctccacggcttcgatctctgcctcgcgcagccccagcgtgcgcacgaactccttccagcgccgcgctgggaccgcgtccatcacgtcgtagagctgcgggcccggctgcagcatcatggctggcgagccggctggggactctggcgagagtgtgggcgcagcagcggggcctggggcagggccagagagagccaattggggtacgtgggccgcggtcgggaggcagagtcaggggcgttcgtgcgggtaccccagggctgaagcccgctggatccggtgggtcagggcatagggcggactccgtcagttagggggcagaaagggaacacgttgtgaaaccacaacttcccaccgcagacaggagaatggggtcaaggcctcaggccactgatgtcccttaccaagagctctgctgggcaactggtcccaggaccatgtcacctgcgggcagagcgcctcctgggtctcggggtagccaggggtccagctgttacccaccaactggacggtgcagatcttctcactgctgtcaggaggtgctagaagggtgtgggcgctgtccaagggtgacagatgggtggcctggaagccaagaggggccccaggtcagccctgcttgccaagtaaggccccttacccgcagtgcctctccaggaggggacagtccctggttcagtcagcagacacccccgcaatgacacctcccacagttggccctgctctcactgtagcccagcagaactcttgcttctgccttgagtcccctgcccccgcctccttcctcttgtcccccagcaccatggggctctccttccattgaactgttagctcctgtgtacgaatctgaactccagctgactgagcaccccttgagggcaggcactgtgctggtctcatccactgatgactctgctcccaacacctctgtccactagggctacccggtgctggccgcgtgccaagctccagggatcatagtaaggcttgatcttccagctccagaaggcagcccagaatcacacagtgaggttcttaccggtggtggggtcagagcctccatcccagcttcatctgctgacagacacagagagattgcggtcagccaccaggcaagcctcctggacctgggtgctggtacagctcctctagggttcctctgcaccccacactccctgcctcagtttccccttctgtatcagggttgagtagactctgggctacccatcctgaccccaggcttctgggtgcgtgtgtgggtgtgtgtacttaccagtaaccaggggcttgtgaggccagcagtggcggtatgtgtaggtcagggtggccccaagcaggagggggaccacaaggccagccaggagcacctggacccagaacactgaaagcagctggtgggtgttgggtggttgcccccctcctcacccgcctcccctcggtccatcccagttctcccactcgcattcccagcacaccacctactctgcctccagccacagacagcggcacagcgctctggacagctccccagggtgctcctgcaagggacgggggtggcctgagggatgagggggtgcatgccaggaggggctccctaagactgcccagcatctgctccatcctagagacccttccctccccaggcctctcactctacccaagaatgttcctgtcattgtgtccctggtaacaaccacagacactattcactgagcttcttctagactacatgaagagtcactagaatgtcaaccccaaaaggac

SEQ ID NO: 320 - DNA, 1245 bp, Homo sapiens
  2nd CpG Island of TNFRSF25
gtggggcctctccctgctgcgtctcctccatttcagaggccccagcatttgcccacagagcagcccacttcccaggccccgggcagaaggggtgcccatgggtggagaggaaactaacttccttccccccgcgcacacaccaggcttcggagggggcgcttaccagcccctcacaagtttcccctccaccagagcaggaatccagcagcgcccccacccccacccatgctttctgttgggggagggacactgataatgctctgcctggggcccccagaccctcctgggaggggtttcctctcagtggaagggctacgccctggaggagcctttaacgagatcggaaagggcggccaacccagcccccagtgaggcttggagtggagacgcgcccggggccccttccttcaccgaggctcttgggacagggctcaaagctgcccctagcctcctgcgtctcaactcaccgccgccaccgccgcgcagccccgcggccgctgctccatagccctccgacgggcgcccaggggcttcccggctccgtgctctctgcccgtcgtggttccgccttcagccccgcgcccgcagggcccgccccgcgccgtcgagaagggcccgcctggcgggcggggggaggcggggccgcccgagcccaaccgagtccgaccaggtgccccctctgctcggcctagacctgagctcattaggcggcagcggacaggccaagtagaacacgcgaagcgctgggctgcctgctgcgaccaggggcacaggatagagctgcatctcggtccccaccccgactctcgccccaaccctgagaaccacttcaaggtagagccagggcaagtgacttctctctcggcctccgcgtccccagccatggaggaggttgggccaaaagtaccgcaaggggccaagcgcagtagctcaggcctgtaattctagcactatgggaggcagaggcgggcggaacacttggggtcaggagttcgagaccagcctgaccaatatggtgaaatgccgtctctacttaaaatacaaaaactagcccggcgtggtggtgcacacctgcagttccagctactagagtggctggggcaggagaatcgtttgaacccgggaggcagaggttgcagtgagccgacatcacaccactgcactccaacctaggtgacagagtgagactctgtattaaaaaaaaaaaaaaagttcctgaagggacccccatggaggacccacctt

SEQ ID NO: 321 - DNA, 4529 bp, Homo sapiens
  1st Promoter of TNFRSF25
aggctgaagtgcagtggcacgatcatagctcactgcagcctcaacctccttcagcccaagttttaaagctatatcaatgtgactctctgtgtaagtgacaaatcatctgtaatatctggctaggatcgctggggggaatgctggctgaaagtgaaggcaaatacccttatgtatctggctaaggcggatccagattgctcttttgccatctaagtttgcctgaagtggggcccacccatcacagggccaaggctccctcctccctatcccctcttcctattcctgaaccagcagcacctgccccaccccaggcccctgctctgctcccagccgcccttccctccatcccacgacagctaggaattacgtggggcaggacacgcagccatcgccatgttcatagaagccaggcaggcaggtcccacagtcagtatctctgcgggaacctgcaatccaggagaggcatgcgtcaccatgggacaggagtgggtcaggcagggagaagggggtctgggagtagagagccctgggtgggggtactcacagagtagccgtgtgtggcggtgcagggccccgcagtctaggcatggttggcagtagaagggtgaactgctgacacattggctgacctggcactccacaaaccagcctggcttacagccacagcgggtgtcggccactgctgaacagttctccagcgccacctgggaggctggtgggggtgcagggagatggggagtggagagttagtcagggccaaaggctcccatggagaggcagaggcattatcccaagataatggagacagaaataggcgaaagacagacaggtacagggctaccctaaaaaagagagaagctcagagattaaggccgaccagaggccaaggcacatggagagatgggaaggtcaccaggaagagagaaggggcaagggcaccctgaaggaggatcagggtggagggttctggcaagggtgggtgcaggaccctcacaccccaagtttgggcccgagccagccacttccttcagaaaggcctgtccttaggaactccctgccaagcactgagaagcccctcaccctgctcatcacaggcctggcagcgggcacattcagaattatggtggttctcccaggccaagaaggtgtcttggggacacacaaggcaggtggagttgccgcagggctccgtgcaaggggccttcaggtagtgccctgtggaaccaggcaggggtcaggcaggcagaggggctgcccagcaacccccgacctgcttcccaccctgccctccctccctctttctctccagctccctacttctctgtcagcctacccctacctcccctgccagcctcctcttacctcccgggcctgcccgccacctctccagccctgcctgccccatgcctctcccacccctgtggccacttacccgctgggcagcctctgcaacaaaacagaccaatcttcttgtggaagtcaccggcacagtcacacctggggctacgagtgccgccctgggcccgggcccccagcagcaccaggaggagcgcctgggggacaggtgctgctgactctcagcgcagctgcccacgtggggcctctccctgctgcgtctcctccatttcagaggccccagcatttgcccacagagcagcccacttcccaggccccgggcagaaggggtgcccatgggtggagaggaaactaacttccttccccccgcgcacacaccaggcttcggagggggcgcttaccagcccctcacaagtttcccctccaccagagcaggaatccagcagcgcccccacccccacccatgctttctgttgggggagggacactgataatgctctgcctggggcccccagaccctcctgggaggggtttcctctcagtggaagggctacgccctggaggagcctttaacgagatcggaaagggcggccaacccagcccccagtgaggcttggagtggagacgcgcccggggccccttccttcaccgaggctcttgggacagggctcaaagctgcccctagcctcctgcgtctcaactcaccgccgccaccgccgcgcagccccgcggccgctgctccatagccctccgacgggcgcccaggggcttcccggctccgtgctctctgcccgtcgtggttccgccttcagccccgcgcccgcagggcccgccccgcgccgtcgagaagggcccgcctggcgggcggggggaggcggggccgcccgagcccaaccgagtccgaccaggtgccccctctgctcggcctagacctgagctcattaggcggcagcggacaggccaagtagaacacgcgaagcgctgggctgcctgctgcgaccaggggcacaggatagagctgcatctcggtccccaccccgactctcgccccaaccctgagaaccacttcaaggtagagccagggcaagtgacttctctctcggcctccgcgtccccagccatggaggaggttgggccaaaagtaccgcaaggggccaagcgcagtagctcaggcctgtaattctagcactatgggaggcagaggcgggcggaacacttggggtcaggagttcgagaccagcctgaccaatatggtgaaatgccgtctctacttaaaatacaaaaactagcccggcgtggtggtgcacacctgcagttccagctactagagtggctggggcaggagaatcgtttgaacccgggaggcagaggttgcagtgagccgacatcacaccactgcactccaacctaggtgacagagtgagactctgtattaaaaaaaaaaaaaaagttcctgaagggacccccatggaggacccaccttcccaagagggctggcctgagtgtgggaactgggcagattcagccctgaatccccggggggcacctggggagaggctctgatggtggctgaaggtggggaagtctgggggtgttggtctggtggcaccccacaccccattacttcccagtgcttcccatggcaagctccatccgtggcccatccgtggcaagtggaggagcacaggaacacaaggaggccgccctgaactcaagtgccccgagtcactgggccccaaagcaaaggactcttcccagtggagtctagacaagtctttataaaagaaccaaaagctcaataaatacgtaacttcacagaacccagcccaagccaggggtggcctgtgggactgggaaggtgggggcagggcaggagtgaatcccactggaggccagtgagggtagaagtaggatgggcagcctaggagcccagccctgaagactcgagctgagctggtaacttcggggagtaggtgacgaggggctgcctgggcaggtggggtggtactgtggcctgggcctcctccactccatccagtccggcaaagcgcaaatcgggcccgggcgtaggcagggatcctgcccagcatccggctcatgcatacaggaggcagtagctgaagcaggtgccggcacgccccaggaggcaggctgtctgctgtctcttggtcaatggcactcttgggggcctccctctgctcagacctccctacagggtggggaggggacagagtccttctttggctgacgccattcagagtggctctggtcaccctctcttccccacggcactcctcaggccccttcactgctgcccaccacagccccctgcgcccagacactgggcagggttcaggctccctccgccatgaccctccccaaatgcgatgctcccaggcatgagtgggcccccatgccagtgccctgagccacctgccctaccccagtccaggccactcacgaggcagtgagcgtggagttaagcagcagggtggtcctgattcggtagagctgggccagggtcagcttcctgtgctgggcagagacccctggtgggggctcaggctggaccctgggagaggcccccgagggcaggtctccacacctcttcctgtgggagcctgcaggttccccggccaggcagccgactagcccaggaccgctgccagggctaggggcccctcggcaatcccagctgggcccagcttcctgaggggagccctgagtcctaatacctggggctggaacagccaggcagagctctgacaggctgcggctgggggcagagggtgtcccatgggtgccagcccctgccagcagctggaggaggctggcctcggacttagacttgagcaggtggggcgggcagctcaacagctggacaggggtgcggcggcggagacggggcgagggtggaggggaaggaactcgtggggactctggggcccgaggcactagctctgccattgggcctggggccacaaagtcttgtaaggaggttggggagagggtgccgtaggcagagtccatggagcaggagcggccgtccaccggacccaggggcagcagctcactggtgggcgtggcagatgaggcagtggtgctgagagaggtctcatcagactgggagctgaaaggaccgctgtcgaactcgggggaggacagcgtgtccc

SEQ ID NO: 322 - DNA, 9283 bp, Homo sapiens
  1st Enhancer of TNFRSF25
agacagagccccgctcccacagtgttcatgacaagaggccattgggaggaagggagcgtggctgggccttcaggagtcctgggctagagtacttgtcctggtttgacctgctgggtggtcatgagcagacgtaccagtgctgagagtcggggctgccgctgcttttccgcatgatggtaggggagctggcagctgaagtgccactgtcctcgccttcctcctcctcctcctcctcctcctcttcctcctcctgctcatcctcctcctcttccaggctctgcaggggctgctgactgcctgggggctcctgtgcacgcagctgttgcagctggttctgcaggcaaggttggggtacatgggacagaatgggttgtgaccagcatctccctaatctgccttgcccacccactcactactctgcactcacctgggcattgtaaatggtgtccacccagccacggcacaaggcctggccactggcctggaacgtgtaggcccctacagcactgtgaaactcattcaggtagataaggaggaaggaccctggttagggaaggcccaagtcagtgtcagcagagacgatggcccccacccatcacagcccctgaccaggaacaggggaccagggctccttaccagggtcccgtagctcccggcacacaatcttgtccacgagcaggggtggcctgatgaccctggtcctctctgccttcttcactgctttggtcaccaacagcagatccgtgaagaggaagcagtacacatccatctgcagtggcaggagggggggtggccagagaggccagcagggtcagggccagggactgtggcaccagcctcccctgggagcactcggtttttgtcaaacactcctcccaccatgaaccttcaagtaaaattaaaatgaagaggaagatgattctctttcactgagatgtacgttgatgacttatctcaatacaagtttacattaaaaagaagactggtgactttgaagtcaccgtgtgcaagctctcagcctgccccatgcctgaaggggccatggcacagtagcaaggctctggggttcctggcccacttgtggaatatggctgccctcccaccaggaacccatgtggcaccaacaaatgggcacaactggtgccttcaagggctaggaccctactgctggatttgtgaatggcaggcagagaactgtcattcactatgacaaggtcactggttcttgagtaaccaccgaagggactgcagagctgagaaccagtgactggggcccaggaggtccctaggaagggcagggcacaggggtggggtggccctggaatcaccttgctgtccttcccctccttcatcctcaggctcccctccagcagcagctgccgcgtctcctccggggaggcgccagggatgggcgctgtcaagtccaggtgcagaaattccttcaggagctggggacggatggcgtgaacgtaggggaggccagagactgactcccatctcagctaggcatcctcagtgagatgcccagcacagcccctgcctgccagctgggccttcctctctcccagccggcaacccccgcagacacacacgcccaccttgtccacttcgtcgctgctgctttccaccacctcgtaggcgtcgatgcggctcaccacggccgccagccgctgccgctcctgccgctgccgcatgcacgcgttcacgtggtggatgaagcgctccacggagccgatctaggggcaggtgagggagcttcaggtccagggtcatgacggagcagagagccgcgcaggggggacggctcccgctggccatcagggttaccatggcgacgacggcctccttggcgcgcggctcctcggtcttcctcagcaccgacttgagcagcagcgggtacttggtgagccgctggtggggtttggccagcatgtcgctcagcttcagcctctggcactgtgggtgcttctccgcccactgcggtgggggagtgggggcgggctcagggcaggccccgccccacccggccccgtccagggtcccgtcctcctgcgcccccgcccacggcacgcgcgccctcaccgtgatgtaggcccggaagaggtcgttgtcgcgcagcaggccgcgcatgtactccatgcagccctcctcctccatgcagtagcggatgtagggcttgaagagcgagccgaactggcccggggcagaacaaccacggcgccggttaccgcgcgctccctgcgggccggcccgcgccaggcgctgcgcaagcgcttccttactgcacttgggcgaccaccccaagggggcagcaagcttatgatccctgtttcctgatgaggaaactgagcctcagccaaagtgaccacccgtggccagggatcaggggtagatggtcaggtggaggctcaaacccgggcgaccgcctcgtaattcctcacccttggccacaaggggtcaagtgcggttacgggcctgggggaggttggggatgctgggcagaccggatcgggccgtggaggcttttcggcgccccagccctgcctcagtgcccccgcctgcgcccggccccgcccgtaccatcttgaagcctttgaggaagtccccgggctgtagcagcgctcgcgtgcgccgcgccttctccagcaccggcgccatcacgctagcccacagcctgcggtgcagctgcgcgatctccgggatgttgctgaacaggcgctccgcctccacctgggcgcggcgggaggtgcggttggccacgcccctccgccaggttagccccgccccaggtccaggtcccgccctccttcctggtacctcacccgccgccgcccccgaatcccagcgcacctcacacagcagccctgactcttgcaggttcaggaggcagcacaggaacagctgtgggatcaggggatggtgtgactggggtcgggaggctgtctcagccctagggccccacccagcctcaggctcccctgccactccttccccttccccgttccaggaggccccacagcagccacggataagaaggctgtaccctttggccttcgcacctgggtagtccagaccctgaggaaagacccagtcctcatagccctcccgaggtcacactgccctggtccctcctggagggaagctcgggggagactggctttgaagccatgcctggaattcccttctccacctctgccctggcttagcctccagatttcacctctgagggtgcttcctccctccaggaagctccaagcccagggtaggtgctcccctccctgagccgaaatccctacactgccagctcactctgtcccgtccagggcgtggcctgctgggcacccagcacacagcaagtgttgggaaacagccactgaacgaaagtgaaagaatgaggcctcacctgtgctaattcagctgaacctgacaaacctgcccgaagccccctcccaggttcctctaggaggcacctcctccctgggcgcagcccttgtctgactttcctgcccccacctcattgccaggcacctgctccttctgcaaaggctcagactcagctgagggctgtcagaaagaggggggcagggtggccacggggaccagcgcagcccctactcacgttgatgatcacccgcagtttcctgatgtaggaggcctccgtgtgcagcagctcccacaccgcctcctgctggtggcactgccgccgggtcagcttctagagggagggcaggatgggtcattcacgaggcctggagcaccttagggtggccggggaggataagcaacctgcatgcaactctcattttcccaatggggacatggaggtcccaagaggagcagggtcacccttgacaccacatgagtaatcacagttaagacacccaagatctgggccctcctctgccattaaaacagccaagcagcacaccattttcatctagcctcagtgtctccaaagtgggctaatggtaacagtggcctctttggggcgtcccatggaacatctgatcactgggtcctcccgagggctgtcctcctttcgggacaaggagggagcagcactgtggcccgcactcacctcatgcccatcaatgagctcccgccagctgtcctccagcctcaggcaggcattgtcctcatcctcgtcttcatcgtactcctcctcccaggagtcatggtcgaagcgcagcccccggggcagcctgggcagcccgaagaggctgtaggtgtgcagcttgccctccagctgctccatcttgtctacctcctggaaagataccctggtcagggtcaggggtcatggccagccagctgcctgaccctgggcagatggggccacatacccggccaaaggcgctggtgctggggccggagctgaaaaagccgctgaagcgactggccgcccggttcttccagctgtcgccagtgttggtgctgccactgctgccgctgggcagagagcagctggagggcgtggggggctcctgcccggggatgctcgcctcccccaggaactccgacatgttcttgcggcggcggccaggggcctggtcagggaagggtggtcagggccgggaccccctgccagcccccatggccccaccccagggcgggtttccagggcctcaggccagcctgggatggaggagggtctctgcatctctaccctggggtgtcccctctcctgggacccagacatatctggagactggaaggtccagacacagatacgcccagactatcatcccccagtcccccagcttcaagcatgaagcacagagttacacactcagatgcactctggaacacagctctgggtggtctgtagccccaggtacaagtgctctcacacacacatgcacacacaggttccctgacccctggcactagaagagtctcagatacaagccctcaccttgggctatggctagatccagagagagagggtcccctactctcccagccaaccccattttccagaagggacaattaaaaccccaagatggggcagtgagagacccagggtgactgcctctgaggaggggctgtgggcccagcctgggccccttcccaccccctcccctgacacaccccctcctcctcaccaagatgtccaggctctcccggcggctctgggcgtccacacgctccagggcggggggcccggtcccagctggccgcagaatcggcaaactcagggacttggagtccttcatgccctgctccaccttgccctcatctccaggcttggctggggctgcatgtgggggccacgagagatcctcagtaccctggtctggtggaggagggggtccccggtcctctctccccggaggatccacaccaaggcctgcctgccctcccccgacagccccgccctgccagcaccctcccctcccccagcagcatccagcagagacacctgtatggtaatgaggctgctcaggcccacgaccaatgggaacctgagcctgggaagggcgcccatctccaggaggctccgccagtcccagcggccccatttggcccaggctgcttctcacctttgacacgaaggtagtgtcccccgaacctgtaggcctcgaaggtgagggacaggggtgtgttggactggtccaggtagatgtccactttgcccagcgcaatgcccttcctttcaaatacaggcagcagcacctccctgcccccaggacaggaggcatgtgtgttagaaccaggcggccagtcgcttcagcttgggccccgcccccacgagcccccgccccacccacagccccagctgcccccaccttcccaacggaaaagggaagcccgcatgggatcacacgcaggtccacagacacctgcccgcagaggtgctcacacaggcgcatctgcataccacggcagacctgtcacacgcctgcccacacgcaggcctggctcctgcatacatgattaaaatgcacaagtacacagaccccaccgcactccctcacactggcgtgcacaccagcacgggtctgcccacgcagggatgcgctcgctcacgggccaccacacagacacacacgtcacacctgcagagacccggagcctgcaacatggggccacccctactcccagtcccacttccaccctgagccccatcaagccctaccccagtgacttcttcttcatggctgggacgatctctgtctcaatgtccacattcaggtcaaatttcagagtgaagcattccttgcttgggtcctgggaggatggtgggggtgggggctgtgagcttctcctcaccgccctcattcccgccctcctccccaccctccttcccaccctccttcccaaccctcctccccaccctccttcccaccctccttcccaaccctcctccccaccctccccaccctccggtctcggatgggaaccccagcaagaaagggaaccccagcgatctcccagacctctgcaccctgggatgcagacctccccacccccatcccggaggaaggcccaggctcggggaagggcgcaggctgtagggaacccgcatctgccggctctggggggctcctcacatccgtgtgtctcctccttgctttcttcttggagagtttcaggcctgtgctcttccggtccctgcagggaagcgaggagggcagaggctggaggtgtgggtggccctcgccagcgtgggcggcgagtgggcctgtggcctccccgcccttggctcaccccaggtgacaggtaacccgcgtggattcaacccggccaggcccgcatagggctgtgcgccctctggtggccaacacgggagtcacatcgaacggtacctggtctggtgtgggctaggatcccaagcaccctggaggctggcccaggctgggtggcctcttcccggagtcaggacagccacaggcgtgggaagaggtctgcccatcagccttacttgaggaaggcgccagagcatctggtcctgaatgtctgatctgagacccagccgtggggccctccaggtatctctctgcccactcatccctcacctaccctttgccatccacagagctctcctcctcctcctcctccaagtccactgcggggctggtgcgcggcgggcatgaccgggtggacacgttccgggccagcacagagccttgggagaaagcaggagagggttgtgcctcccccgcccctccttagcctgcagcatggctgcctccagagggaccacagcctgttaccctggaacccccagattaaaggtagcaagggcccttcagttctgtgaggagaggggctcagtcattgttttttgtttttgttttgagatagggtctcactctgtcacccaggctggagtgcagtggcatgatctcggctcactgcaacctccacctcctgggttcaagcaattctcatgcttcagcctcttgagtagctgggattgcaggcgtgtgccaccacacccggctcatttttttgtatttttagtaatgacagggtttcaacatgttggccaggctgttctcaaactcctgacctgaagtgatccacccacctcagcctcccaaagggctgggattacaggtgtgagccaccttgcctggccttagtcattgctgtctatccccacagacccaaaaggacacaaaggccctgggatgacacccatggtgaagctccaccccaaaaacaaactcacctgtggcctcagtttacccttctataaaataaggataaggaagccttgcctctgaggttattacaggaagggaccaaagtccatggctctttcttccaggcctcccctcccccatgctgtgaccacacctgaattcccaaggggccctggcagtgggagagagtcttttgtttgtttattgttttttaagacagggtcttgctctgtcgctcaggctggagtgcagtggcacgatcagggctcactggagcctccattgtcggggttcaagcgatccttccacctcagcctccgagcagctgggaccacaagtgtgtgccaccacacctggctaatttttgtattttttgtattccagacatgagccaccgtgcccaaccagaagaatccttttgttcctctgatcagctgggaaaggactcgggggttggcatttctcaccaggcctgggtgcctgcgagccactcctccataggcagttgatggtgggcctgagctgggtccctgctcagcaagaggaatttcttatttcctgctccaagtgcctcctgacctggccacccccactccacactgcctctgctaggcccacagcctggcttgcaggacttgtccagaagtcccctgccctgaggataggcagaactagaaagaaaggggccttctctgtgtgggccacaggccaggggcaaaagcagctgggggaggtgagaaccagtgagagcacagcaccagatagagaaaggcctgcctctggaaggggcacgctcatggactttctctcttgctaaaaaacatttggaacaaaaggaaccgtaacatactcgggtttcattatttacagtcgacttgtccttatgacgccctagcacgtttccgacagttactgaaacactgacacaggagctctgggggccgagctgcggctcccgcctgtgctcaccttgtgggggaaggtcgaagcggacatgcccatcataatgcatggtgctgtggaacttgctgtcacaggcctcgcagaggttgaggggcccccggcggtgcagctgctggcagtcggcgtggtgacatacctggggtggggacagaagccttcaggaggtccacgagatccaccacatccctcgaccccggcccagcgctgcagggacttagaatgaactgccctccatctctcgatccagggtgaggagacgccccccagcagtcccccctctcccacatcatcaagtttcccctctgctggatcatttcccccactgccacaccaacacgtggttatttctccatctttttcttttttttctttttctgagacagagtctcattctgtcacccagactggagtgcaatggcttgatctcggctcactgcaacctccgcctcctggtttcacgcaattctcctgcctcagcctccccagtagctgggattacaggcgcacaccaccatgcccagctaattttttttttgtatttttagtagagacagggtttcactgtgttggccagactggtctcgaattcctgacctcgtgaacagcccgcctgggcctcccaaagtgctgggattacaggcgtgagccaccgcgcccggcttctccat

SEQ ID NO: 323 - DNA, 1632 bp, Homo sapiens
  cDNA TNFRSF25-004
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagagtaggtgtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 324 - DNA, 1625 bp, Homo sapiens
  cDNA TNFRSF25-001
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 325 - DNA, 1441 bp, Homo sapiens
  cDNA TNFRSF25-013
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagaatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagt

SEQ ID NO: 326 - DNA, 1119 bp, Homo sapiens
  cDNA TNFRSF25-016
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 327 - DNA, 705 bp, Homo sapiens
  cDNA TNFRSF25-015
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 328 - DNA, 764 bp, Homo sapiens
  cDNA TNFRSF25-012
ggaggagacgcagcagggagaggccccacgtgggcagctgcgctgagagtcagcagcacctgtcccccaggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgatgaagctgggatggaggctctgaccc

SEQ ID NO: 329 - DNA, 3184 bp, Homo sapiens
  Coding Sequence of the TNFRSF18 Gene
tcactggacaagtgtttattgaaggtcccctgcagccgggtcccgtgctgggcactgcacacccacggacacagcctcccgtcctaagaccccaccccatcagggccagcaagggaggaagggggccatgactgtgtctctctctccctcctgcagggcccagccgcggccgccgaactgcatggtccagggcgctggtcactgccaccttcctgcacccacttctgctgccaggggagcagggcccggcccagagcagaacgcagagcccctgcggcctggggagctcctggggaggggctggctgcggtcggtggccccggaggacggccaggctcacacccacaggtctcccagccgccccttctcctctgccgatcgctcgccccgctcttcctcggggaactggcagcttctggcgtcttcggtcgacggcggcacctccagcagcagctgggtctctgcaggggggccacggtcagcaggcagccatgctcccacctccccgcaccaggctgtgacagacctcggggccacatgcactgactcctcagctgccagatgtgcagtccaagctgggccgaggtcaggaggaggacgcaggcggccacggccaggaggacgacggtcagccacccaagcggctctgccggcggggaccctgggacgcacacagcgttgtgggtcttgttcccagggaacacagtgagaaacccgaactgggtgcagctggaatacatggacgcggcctcctatcagcccccggacacggcctccgatcagcccccggctgctgccctccgtgctgtctggggcaagggacaggagaggacccttcctcagagtgggcctggaccacccggccaccggcagggcccacccaggactcactctgtccaaggtttgcagtggccttcgtggcccccggagaaggtccccgaggcacagtcgatacactggaagccaaaactgaatttccctggtgtggggtgtggggggagggagggagggaggctggtggagttgctgggatggatgaggagggcgtcaggccagtgcaggggtccatctggggtctgggtgctgagtagaatgccccccccatcatccattcaacagagttcttcatggcccaggactggggcccatgtctgcccgtcccaggtggggcgtctggggtggggcccagtgagggcacctgggggaggtgcgcagagtgcagtgggcctgccagggaggggaaaggcctgcccattgggggctgagggtgggcagaagccaggcaggacccagtagaacagagggtggagaacagtgagggtcccagagagagtgaggctgggtcccagttgaccccagaccctgccccgtccaacctgacacaacctccccagttgtaccttctcccagctctcatgtgcccagcctgacctctcctgtcaggtaaacaagccgctaagaggacttgagctgctccttccagaacagggtgcagccccaggccccagacaggactccggggggcacagggcaggctctttcagtatgtggtgaggacagacaggatgggtgtcccgggcctgagagccagacagctcctggaacccgcccccacctccccgcagggttctcacagccctcgtgctggatggagaagcccaggctgagaaagcagggacaggacacccccagagcttcatggcctgtggtgcctgagcatggcctggcctgcccggcctcacaggactccggaccccacacaccacatgtcctcgccggacacctgtgcccacgagctctgcctcgggccctagtggaacccctggcctgtgtggactcccagaggcacctccaggacttaccctgggactgtaccccctggcctgggggacaagggtggtgccggcaggtcgtgcagcaagggtctccgcagtggaattcaggctggacacacatgcagtcccactcggaacagcactcctcgcctgggcaggagacaggccagccccccagcagctgggctgaggccccctcctccccaggcctcccctcggccctccaggggagtgaggttgtccgttctccacccacagttggctccagggagcagagggctcctggctgggagtctggaccctgggtttatccagctgtctctttctcctggggccatgtggcctggctactccccctttgcgccccacagctgcccctgcccaggtgctaactccatatgcaaccaggagctgcccctgcaggacccaggggtggcccccaacagtgcacagtcccctggaggcccgtcgacacctcagaggccgcctgcctggtgtctgggcgctgctgtccccaccaccagccacactgggcctccggacagagcctcccttcccaacccacaggccctggaggaagaagctctggggtgacttccctgccagcttcctctccagaccagccgtgtcagctgaaccctcatccccaggtgcaggtcagaggcaggcagcaggccagacggtggtgcaggggggccctcaactgggcaggagggggctgggcgatggccaagggctcacgacccgcccagcaggacctggaacagccgtcctccacctccagaccccagacccctcttgagggcgctcccacctggctcacccctgctcccggccggggccactggctggagctggcacacctccgcctccctctgggatcctgcctccctccggaaggctcccgctgctggcggctctgtgcccaccctccttagacctcagcaacgccggtctgagcacgggaaggggggcgcccacccatcccggcttccgcgggacgccttggccggtccgcgttaagtaaacgcggtttacttacccgggtaatcgcggcagcagcgcgtcgtgtgaacccggcagcagcgcgcgtccgttcccgtcccaagcaggaggcgcccagggccgcacccgggacccccggtggggcgctgacccaggctgagcgcgcacagcagcgccaggccgcacagggcccgaaacgcgcccatcgccccgtgctgtgccatgctcgggtttcaagagcccacagccagttggacacgccccgtccccgtcctcacccgccctgcccggaggtggctgggaccgttcatgacctgagaatcccgacccaggtgaagtgcgtg

SEQ ID NO: 330 - DNA, 14526 bp, Homo sapiens
  1st Promoter of TNFRSF18
cctgagctcaagcgatcctcctgcctcagcctcccaaagtgctgggactacaggtgtgagccacgcgcccgaccaacttgtgtatttctagtagagatggggtctcaccatgttggccaggctggtctcaaactcctgagctcaagcaatcctcctgcctcagcctcccaaactgctgggactacaggtgtgagccacgtgcctggccctcacactttctgttagtcctttcaaatgggatcttccaaggaactactagacataagaaaacaaataatgacaatttttttttataaatgaggtctattttgctatctccagttctggggatgcatgctgttggttttttgaggcaaccattgagctggggagcagaggatgaaaccagagcacgttaaaatacaacataattcacagttcttaccaagattcgagattttacgtatcccatttgctatccgtctcttctgctcaagggcagagatttcctgtgagttttcctcactctcgtatctccagtgcctgacacaggacaggagctgcacgagtttgttgagtgagtttctggctgtgaacctgtgaggctgagtgcacgaacgtgtgggcaggtgtggctgtacaggtgcgggttcagatgggagtgcaggtgagggatgtggctgtggctgttcagacctggggtgtgatcagggcctacgggccgcagccaggatgcctccctgcctccctgcagaagcggatgcagcagatcatggcccactgctttctggccgccaagcccaagctggactgcaagctgggttactttgacctcattggctgtgacttcctgattgatgacaacttcaaggtgctgtcctgggcggcggggggcacagtagacagatgcaaggaggcaggggccatctgtacaccctgaccacactggcaggccccaggcagaatctgcagtcagcccccaccctgcctgcatgcagccctggggatgggtgtatccatgaggctcaccccctgtgcagctaggatggaactgcaccccctcctcagagcagccccctcaggccagagcttcagaccctcagagcttcagtggacaaacaggggagcaaggctataggaaggaagcaatctcccagagccatctgtctgaatgaggaccagggcctctgcctcctgctggcccagtgggctcggggtgaggagggactgactggcgtctggggcaggtatggctgctggagatgaattctaacccagccctgcacaccaactgcgaggtcctgaaggaggtcatcccaggtgtggtcatcgagaccctgggtgagcctccaagcccccaccccacacccccacaacctgcccagtcttgaatgcctacctgccctcttcccaagttcagacccccacagatggggctcttccacctcccgagggcctgtgtggcagcgccgccccctgccccaaccttccccacacctcagctcacctgggtcccacccctcacaccctccccaccccctccagccccagcctctgccccccactcaccctctctcccccacccgcaccagacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccagccgtgctgcctgccctcagggacctataaagcccactttgctacaaacacagtctctgcagcagagtcctgccacctcagcgcccctgagcccatgcccaccggggtcacccccaccacaccagcactggcctgaaagatgctcccctgggacttccccaggcccccactagcccccagtccatggctgggccctgtccctggggagactgtgctgagggagggggtctccgcggctgggcccagtcctggggggctgttctgagggagggggttccccacggctggtctatactccctcccgggctgccccatcctgggctcccgcccaccaccctgtgcccctcagcacctgggccctcctgccgccctgtgaccccacggcccccatggcctggccggtgatccaccattgcctgtcatccccaggaagggtctgaacccctctggagctccaaaggaggagccccttgagcccaggattgctgccgtgggcacccacagagctcgccccagcctgcctggcacagaaccttcctgggcctttaagccccaagcctggcgctccagctccctgagcccccaaccttcctgcagtggccccaggacttagccaggggtgaggggcacagggcagctagccccaacaagagggtcccacagaagacatgctaagcccacactggccaggccctggtcagccctgtgtagccgctgatggttctgttccccatgggtctgggggtttgcgaggagagctctggcgtcccggggcctctgaggcgtccacactacccaccccctcactcatctcccacccagagagctaaagtgtatgggcctcttcccaatggctggctcaaggtgtctgtgccccccaagtcgagacctgaggatcggggggccccgcccccaggcccaccccccacatgccctgcctccgactccacacggtcacggccaagtcgccggtccctcctcctgccctgctccgcagccacgggggactgaggggccagcagaatctgctttggccacgtggccaccctgcgctccacagggacagcagctccattccctgggactcggcagccccggcactgctagaaggcaccgtcggctgtggtctctggccagcacagcaggtggggcacagccagggcgccaggaagaggagaaggcaggacagagggaactggggaccacagaggccaaaggaggccccaggtctcagagccagtgaggaaccaccccaggccaggggcagcccccaccaacatggtcctttcgctggggcctggagtgggggttcccaggtgaggggctgggaacacacctgtcattgtgatggggtccccagtcccctcccagcaggtctgttggaccctctgggggccaagggcagcagcggcctgttctgcagcccactgaggccagggaggggtgaagcaggaggggcctgggaggggtgaagcctccatggctggccaagcacccaggacttggttaatccacacctgctcttaggggtcagggccacactgcctgacggcttccaaggccgctaatggccacatcacctcagggtcctccctctgctcttgctaccctgatgcccctggggcccctgtgccctccggcctctgccctcggctctgccccacatgcctggtgctgtgtcgcgccatgatcccaggtcaggactacatcccctggtgacattggaaccgtccagctcccctccctgtggcgcgtgtggttacacccccaggctcaggggccccacgacgtcagcagaggtcacctgagcccgaggggacaatggaacctttgccgcccctgggccctgactggatgtgtcaccgccagaacccatgaggagggtgcacgctggcagtggcctgccctggcgtgaccgagccccaccccctgcaacccagggccccctgaagacctaagctgaggacccagatactgttcaggagtccttggtgccccaaagagcccaaaagtcaatgaataaacaaggtttccagagaacccaggaacaacggccacatccccgccgcccagcccgtaagcacccgtctgcgaggtcacaacagcatggaccaccagggagagggggactgtgggtgcctgagtatctggcagtacaaggtgctccccaatattcaagtgaagtgaccagccaggggccacaggaaaggcatcagaactcctcggggacacgagaagttcaggcagggtcagggcgcttcctggagacggcgccaagctggagcctgggacccaaggtggaggttcctgacagctgacccccccacctccctctccccctctctcttccacaggtgagtcctgggtcctgctgccaggtagcggactcaaggggaaggtgtgggggattaagctgccccccactcggacccaggtacagccacacaccctccatccccacagcctccatcgtggggcctggccagcacactctcaccagcagcgggggcctggggtctgctgagggccagtgggcctgcgtgtctgtttcagctaaagagacctcggaccccggaggactcgaggcctgcgtgtccatggggccccctgtgcccccgccccctccagcccgtctcccctgagtgtgtctttaagacggggaccaggacaactgaattaccaactccggaaagacccccaattcctggtttccaggaagatgagatttgtgagaggcgggggtctgcttcctccccaacgccaggcgccaccgcctcccatgagggtcactggccgagaggagctagccctctcctgtcctgtcctcagagctcagcccagcatcggaggggacagcagtgatgacccaggtcctggtcagcgggcacagatcccagcagctggggcagccggggaccacctgtccctcaaggacctccccacctgtcctggcgctgggaaaggctgtgtccagctctgtctgcgaaggggcccccgccataggtgtctctgtcagctgcggggggttcccgcagggccaagtccagatctcagtggagggtggggagggggctggctgggaggggaggctccgcagcggccggaagcgcttctgggaacagaggtggcctccggcccttttctcaaaagtccgaccccagcgggaggttggggcggctgcggttttccgggcagatggaggccgccctgtgcgagtggctcgggcttccagggggagcagagaggggcccctccccgtggagccgagaccactgcgccccgagtgggagggggcggcggcctctccgccgcgaccccggccccttctccgcacccggccccgcccgaccctccgcgcccttgggacccccccctccatggcgggttcgcgctggcctcggcctcccccactgagacccctggaggcgcccccgcccccacgcgcgagaacccgcccgcctcccccgggctccgcgacgcacgctggggcccccgccaggcccggagggtcgcgctccaggtaaagcgcgcggggcgggcccgggaggagccggagactccggagaccccgcccagagcccgctccgccgcccgcggaatcccccgcccgtccgctgtgcgtcagcccggccgcccccgcgctgacgtttccgcgccgaggcccacgcgaggccgcccacgaggagtttccgcgctgagtcagccccgcgggacccgcgctacgcgggccgccggtgttttctggggccggtgcgggacagccccggtgtggggggcgcgtggggagagccggggccaggcggggaggatccgggctgcaggcaggagtgcgcggggcagggcccgaccgctcagcctccccggggctcacacgggaggagcgcgccgagccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagccccgagcccagtacccagcctccagcccagtacccagcccccagcccagtacccagccccgagcccagtacccagcccccagcccagtacccagcctccagcccagtacccagccccgagcccagtacccagcctccagcccagtacccagccccgagcccagtacccagcccccagcccagtacccagcctccagcccagtacccagcctccagcccagtacccagccccgagcccagtacccagcccccagcccagtacccagccccgagcccagtacccagccccgagcccagtacccagccccgagcccagcacccagcctccagcccagtacccatccccgagcccagtacccagcctccagcccagtacccatccccgagcccagtacccagcctccagcccagtacccatccccgagcccagtacccagcctccagcccagtacccagccccgagcccagtacccagcctctagcccagtacccagcctccagcccagtacccatccccgagcccagtacccagcctccagcccagtacccatccccaagcccagtacccagccccgagcccagtactccacgacgccgaagggccgggtcctgcctccagggctgagcaccttccccagtgtccctgtgccacccttgggctctccacactccaggtcccatgttggggggggaggggagcagacgtcccctctgccccgtccacctactgtgagctgggcccaccgccccactgggagctgagctgggggccaggtgtgctgtgcctccagggtgctgctgagacgcctgcaccagcctgcccgccactccccggcagctgagggagcctgtatcagatctcacctggagcctggagtgggaggctgggcgggccgagggtgggatggtgaggagagagggctggcctggagacggggccgcccagcaccagaaagtgctggatggcacccgggggccggcaggctgtgtggccagaaaccagagacccaggggcaccagagaagagccccagaacgggggaagccgctgagcctgtatccctgaggagcgctgggcccaggactggaatggcccctcctcgggccccacccccacccagccaggagttcccagaatgggccctggctgccctccgctttgccccctgtggaggggaccacggccaggcatgagcacggtgccccaaagcccagccccgggtgccccgtcctcccccagcacccagcatgcatccactcaggtcactggacaagtgtttattgaaggtcccctgcagccgggtcccgtgctgggcactgcacacccacggacacagcctcccgtcctaagaccccaccccatcagggccagcaagggaggaagggggccatgactgtgtctctctctccctcctgcagggcccagccgcggccgccgaactgcatggtccagggcgctggtcactgccaccttcctgcacccacttctgctgccaggggagcagggcccggcccagagcagaacgcagagcccctgcggcctggggagctcctggggaggggctggctgcggtcggtggccccggaggacggccaggctcacacccacaggtctcccagccgccccttctcctctgccgatcgctcgccccgctcttcctcggggaactggcagcttctggcgtcttcggtcgacggcggcacctccagcagcagctgggtctctgcaggggggccacggtcagcaggcagccatgctcccacctccccgcaccaggctgtgacagacctcggggccacatgcactgactcctcagctgccagatgtgcagtccaagctgggccgaggtcaggaggaggacgcaggcggccacggccaggaggacgacggtcagccacccaagcggctctgccggcggggaccctgggacgcacacagcgttgtgggtcttgttcccagggaacacagtgagaaacccgaactgggtgcagctggaatacatggacgcggcctcctatcagcccccggacacggcctccgatcagcccccggctgctgccctccgtgctgtctggggcaagggacaggagaggacccttcctcagagtgggcctggaccacccggccaccggcagggcccacccaggactcactctgtccaaggtttgcagtggccttcgtggcccccggagaaggtccccgaggcacagtcgatacactggaagccaaaactgaatttccctggtgtggggtgtggggggagggagggagggaggctggtggagttgctgggatggatgaggagggcgtcaggccagtgcaggggtccatctggggtctgggtgctgagtagaatgccccccccatcatccattcaacagagttcttcatggcccaggactggggcccatgtctgcccgtcccaggtggggcgtctggggtggggcccagtgagggcacctgggggaggtgcgcagagtgcagtgggcctgccagggaggggaaaggcctgcccattgggggctgagggtgggcagaagccaggcaggacccagtagaacagagggtggagaacagtgagggtcccagagagagtgaggctgggtcccagttgaccccagaccctgccccgtccaacctgacacaacctccccagttgtaccttctcccagctctcatgtgcccagcctgacctctcctgtcaggtaaacaagccgctaagaggacttgagctgctccttccagaacagggtgcagccccaggccccagacaggactccggggggcacagggcaggctctttcagtatgtggtgaggacagacaggatgggtgtcccgggcctgagagccagacagctcctggaacccgcccccacctccccgcagggttctcacagccctcgtgctggatggagaagcccaggctgagaaagcagggacaggacacccccagagcttcatggcctgtggtgcctgagcatggcctggcctgcccggcctcacaggactccggaccccacacaccacatgtcctcgccggacacctgtgcccacgagctctgcctcgggccctagtggaacccctggcctgtgtggactcccagaggcacctccaggacttaccctgggactgtaccccctggcctgggggacaagggtggtgccggcaggtcgtgcagcaagggtctccgcagtggaattcaggctggacacacatgcagtcccactcggaacagcactcctcgcctgggcaggagacaggccagccccccagcagctgggctgaggccccctcctccccaggcctcccctcggccctccaggggagtgaggttgtccgttctccacccacagttggctccagggagcagagggctcctggctgggagtctggaccctgggtttatccagctgtctctttctcctggggccatgtggcctggctactccccctttgcgccccacagctgcccctgcccaggtgctaactccatatgcaaccaggagctgcccctgcaggacccaggggtggcccccaacagtgcacagtcccctggaggcccgtcgacacctcagaggccgcctgcctggtgtctgggcgctgctgtccccaccaccagccacactgggcctccggacagagcctcccttcccaacccacaggccctggaggaagaagctctggggtgacttccctgccagcttcctctccagaccagccgtgtcagctgaaccctcatccccaggtgcaggtcagaggcaggcagcaggccagacggtggtgcaggggggccctcaactgggcaggagggggctgggcgatggccaagggctcacgacccgcccagcaggacctggaacagccgtcctccacctccagaccccagacccctcttgagggcgctcccacctggctcacccctgctcccggccggggccactggctggagctggcacacctccgcctccctctgggatcctgcctccctccggaaggctcccgctgctggcggctctgtgcccaccctccttagacctcagcaacgccggtctgagcacgggaaggggggcgcccacccatcccggcttccgcgggacgccttggccggtccgcgttaagtaaacgcggtttacttacccgggtaatcgcggcagcagcgcgtcgtgtgaacccggcagcagcgcgcgtccgttcccgtcccaagcaggaggcgcccagggccgcacccgggacccccggtggggcgctgacccaggctgagcgcgcacagcagcgccaggccgcacagggcccgaaacgcgcccatcgccccgtgctgtgccatgctcgggtttcaagagcccacagccagttggacacgccccgtccccgtcctcacccgccctgcccggaggtggctgggaccgttcatgacctgagaatcccgacccaggtgaagtgcgtgtgaggagggggtgtagacactgcggacacagcccggtcccccgcaggtcgccggcaggggcggggaaaccaggctggcggggatcagaaaggttttctatgcaaagtctgcggccacattggtgtccccagtgcagggggcggcgtttatagcaccttgtcccatgggggccccttggagggcgggggtcagccaatcactcctccatcccactgcctccgggtggtatctgcgagtccccgagaggtctccacaaattctggccacccccagagagcctcaaccatggagccccgtgctggggaaccccacagaatggggacagggacccctcggctcagcacaccccacctggctggcttcaggtgtgaaactcaccatgggctgcaggcctgtgggctcccctcccccttgcttgcagctctccaggacccccctcaggccaacctgggaagttccccggggcttgggaggggcaccaggaggagctggtggggagacgagagggtgctggcgcctcctcgggacagtgtcagccgcccccgcgggcacccagggcccggtctctcagagccaccttcatccgtcacaccagacagatccaggtcccggagggagttgaggaggagcccctcgcagagctcttgggagactgtcctatgtctttctgagcctcagtttcccctgtgggcaccgaggggttctgggaccctgcctccaccaggaagcctccctggattgcccagccctgcttctgcgccgtccagcacaggtggagacccccatgaatgctgggggtgggggctctcgggaacgtgagcgtggatgtggttcaacacccttttgagacctgcagccaccgcctcaccccgtaaggcggttcctccttttccaaggtaaatgacaggaattagctgtttgtgacaccccggagttctcaaatccaagatgtaggagcctgccttggagaggcagccctcagacactgcagagaaggaaggggtctctgcagctccaggccgccccgacgctcggaaggaaaggggtggggccagctgggcctgggggcctttgagaggcctggagatcttcagccccgaggctgggagggggtctgggcccctggatagaaagaggcgccatcagtggctcacgcccgtaatcccagcattttgggaggccgaggtgggcctcggatcacctgaggtcaggggttcgagaccagcctgacccacatggagaaagcccgtctctactaaaaatacaaaaaaaattagccaggcgtggtggcgcacgcctgtaatcccagctactcgggaggctgaggcaggagaattgcttgaacctgggaggcagaggttgcggcgaaccaagatggcaccattgcactccagcctgggtgacagagcgagactccatcacaaaaaataaagaatgctcatcagaccacacggtgtgagtcatccatctagaggcagggacagagttagaggagcgagcagtttatggggccaagtgggaggcggccagcgggcagaggagcccctcccccccgccccgtggcgcagctgacactttgaacagccggagagcagcttgccacacagggtggtccccggaggggctgcaggggtgtgacgtccaccctcccatccctctcgccgcagaaggcccctccccggctccccgtgactcctatccttgggctgcgaggctggaggtgacttgttcatcttattgagcagctcaccggtgacacaaatgacggggcattcacacagcagagcagcccacgggccgggcgagggacagcccttgcgtacgtccagaagggcagctgtgaggccccacggggagggtgcagatgggcactgagccagagttcaggcagggccttcggcacagatggcacaggagttgccagcagagatggcgtcaggcgagggggcggggagggtgagcatggagaccaagaggaggtggccccgtgtccatctgggggtgcggcaaggggtcctgctggggaataagtcccacggggcctggggggtgctgtgcccagaggggaggagacaggaagcgatgggtatgggcgccaggtttggggaggaggcccctttcccatagccgtcgacctgcgggccccacaggatctggccgctccagtcccggccacctgaccccttcccccacccacccgccatcctgcctggaggtctggcctcgcctgccccacggggcggggggcggggggctctcagaggcgcggccccaaccctgtgcagggcctgcaggctgaaccgtgtgcaggaacccggggaactcggtgaaggtgctggatgggggacaggacggcctctgacttccctatgctgcggggggggaggcttgtggttagcagagagtgggtggaagacagaggtttgaggagagagagacccaggggagaaaaccagctgcagaggcaggaggggtccagggcagcccgaggccagagatgggcgtcttccttacagccacctgtggtcccggcaccttgggctgttgtgagtggcgcgtggcgctcccactgtgcacccccggggccggttccccacttccacgacaccggcaggggggagccatccgccaggcacaggaggcctggacagccgtgggcagcgtgcgctgttggaggacgcagggagagggaaggctggcccagggacgctgtgtggggcagcgggtgcagctgcggggctgggccacaccagccacggtagccggagtgtccaggctgtgccaggccctcagcaaaaccttccatgaggcttcatgtgtttcttcttaagtaatttttttaaatttctttttttttttccagtcacgtctcactgcagcctccatctcttgggctcaagtgatcctcccacctcggcctcccaagtagccgggaccacaggcatgcaccaccacacccggctgattttttctatttttcatagaaaagggtcttgccatgttacccaggcgggtctcaaactcctgagctcagacgatcgtctggcctcagcctcccaaagtgctaggattctaggcgtgagccaccgtgaccggcctcggctgtgtgtttcttgctcatgagtgcagtgagggccaggcgtggtggctcacacctggaatcgcagtactccagggcaccgaggcaggtggatcacctgaggtcaggagttcaagaccagcttagccaacatggtgaaaccctgtctctaataaaatacaaaaattagccgggtgtggtgctgggcgcctgtagtcccagctacttgggaggctgaggcaggagaatggcgtgaacccgggaggcagaggttggtgagctgagatcacaccactgcactccagcctgggtgacacagcaagactccggcaaaaaaaaaaaaagaaagaaaaaacaagtgcagtgagacgtcttagccctcgggagtgtttctcttcagcccctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggctctgtgctgctcgaaggataccccactcccagacaccagcttgagaagattcccgcacggccgg

SEQ ID NO: 331 - DNA, 1179 bp, Homo sapiens
  cDNA TNFRSF18-001
cacgcacttcacctgggtcgggattctcaggtcatgaacggtcccagccacctccgggcagggcgggtgaggacggggacggggcgtgtccaactggctgtgggctcttgaaacccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgagagacccagctgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccag

SEQ ID NO: 332 - DNA, 851 bp, Homo sapiens
  cDNA TNFRSF18-003
atggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccagtga

SEQ ID NO: 333 - DNA, 705 bp, Homo sapiens
  cDNA TNFRSF18-002
atggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggaagacccagctgctgctggaggtgccgccgtcgaccgaagacgccagaagctgccagttccccgaggaagagcggggcgagcgatcggcagaggagaaggggcggctgggagacctgtgggtgtga

SEQ ID NO: 334 - DNA, 727 bp, Homo sapiens
  cDNA TNFRSF18-004
atggccccaggagaaagagacagctggataaacccagggtccagactcccagccaggagccctctgctccctggagccaactgtgggtggagaacggacaacctcactcccctggagggccgaggggaggcctggggaggagggggcctcagcccagctgctggggggctggcctgtctcctgcccaggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgagagacccagctgctgctggaggtgccgccgtcgaccgaagacgccagaagctgccagttccccgaggaagagcggggcgagcgatcggcagaggagaaggggcggctgggagacctgtgggtgtga

SEQ ID NO: 335 - DNA, 2813 bp, Homo sapiens
  Coding Sequence of the TNFRSF4 Gene
tgccggtcggagactcccgtctgccaaggtttttattgtggtcccgcggggcaggaggtatgcatggcatacgtaagcagagagccggaggcagccatcggcacctagaacggtgcagagttggcccaggagcgtggcggggcaggcggcctgcacctgccctgctcgcccagcagaccctccgggctccagcctggcggggcccagcgtccaccttggtgggcccaggtcagatcttggccagggtggagtgggcgtcggcctgctcctcttggatgggggtccggaaactgcctccccctggggaggaaaaaaggagagattggtgggtgggcctcacccgccaggagcagtgcggcagggccatgaggcactcaccagggggcttgtgggcatcggggggcagcctctggtccctccggagcaggtacagggccagcaggatggccagggggcccagcagccccagcaccaggcccaggcccaggatggcggcaaccgcacggcctgcaggaaggggtctgctgggtggggtccacaggaggggcccccatgccgccctccccttctcctattcgggttgggggccccgctgggctgggccaggcgcccttacccccggggacctccacgggccgggtggagggtccctgtgaggttctgggccaggcttcagtgggctggacagtgatgggcctggccggggggccctgggtctcctggggctgcgtggctggggggtccctgtcctcacagattgcgtccgagctattgctggccggctgcagggtgtgcttcccagccaaggtgcagctgttggggaacaggaggtgttgctcaggccagaaaccccctgggacccgggagatgcggtggggataacagggtccacgctggccagccacaggcagcatctaccacagacaccaggccagtgacagccaaggacgctgcccagccccacgtgccccccacaggggcctccaaggccacacacccttctcccacatctacaccccccaccagcacctccctgtcctgtgcccccagggcctcccagctgcggagggtgagggtcccacacacccagctccacccacagggaaaggctgcccccaggcagcagcttcctgctccccaaccaggtccagccacatagccaggcccccagggccaccagcacctccccttcccccaaaactgcccccaccccacctgcccccccagcccctcccagctccccagctcctccgccctcctaaccaccccaacccccccccagcccctcccagcccctggccaggcccctcacttggtccagggcttgcaggcctggttgtcgcctggggagaagtgccctggagggcagggggcacagtctgcaacaaagatagggtggtcaggggctgcccacaggccccgggtgctggggacatggggcagagcctgtggggcaggcacttgccccccatggctgggtggtgggtttggcctctggaagccctccctgcccacatcccacccgtgggccctgacccgggagctcggtcttgaggatgccagaggaggcaccggtggggccaggtccctgcggcccacggcccatctgcgtcacagacagccgctatgcacacccccaaccgccggccgcagccaccgagctcaccaactccaggcttgtagctgtccaggggctgggtgcccgcccggcagcggcagactgtgtcctgtgtggccgtgcacagctgcttccgctcactcccacttcctgagcaggggccggatgggggggtggtcaggtgggggctgtggacagggtcctcaggaagcgtgggcactggaggacaggttggcctccccaccacacagagggccgtgggcaggggtctgcggcctcccctgagacttggagcccctgcagcccccgaggctcctgggccctcccttcctggccacaacctggggctggttccgtggcagccccagccacccttccctacccctccaccgcctccagccgccagccccgcctgcggcagggtctccatggcccaaccccccagcctcactgctcaggccagcaaggccaggccacatggccagcgtggtctccccgactccacgtggcctgggccgagtctgggcccccggagggagagggggtgcccctgggagacgcctcagctcctcgaaggacccctgtggcggagcagaccccgctgtggtttgaggttcgtttctgcggctgtgggagccccatgctgctgcgtgggaatgtgggtgccaggctgccgccccctgtgctgggtggggctgtggggccaggtgggagctcactgaggttacaccacgtgcagggcttgcacggcttggagctgaccacgtcgttgtagaagcccggcccgcacggacggcacaccgtgttctgggagcggctgcagcggctcaccatcccgttgcctgcagcagaggccggcgtcaggcagcggtcaggccccaggcttgcgcccgtggacccccccaggcggctcctctgccaggcttggccggcccctcacccgccccctccccaggaccagcctcctggctggcccatccctgccccagcccccagtccctggagtgcccgtgcgtggcgacccctcctgaggcctcacctggcctgcactcgtggcagcaccggtcgttgctggggtaggtgtccccgacacagtggagccccgtcacggtgctcagccccaggcccaggaggagcagagccgcacacggcccgcggcccagccgccgagcccccacgcacatcctcgtctctg

SEQ ID NO: 336 - DNA, 6045 bp, Homo sapiens
  1st Promoter of TNFRSF4
gtcaggagttcaagaccagcttagccaacatggtgaaaccctgtctctaataaaatacaaaaattagccgggtgtggtgctgggcgcctgtagtcccagctacttgggaggctgaggcaggagaatggcgtgaacccgggaggcagaggttggtgagctgagatcacaccactgcactccagcctgggtgacacagcaagactccggcaaaaaaaaaaaaagaaagaaaaaacaagtgcagtgagacgtcttagccctcgggagtgtttctcttcagcccctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggctctgtgctgctcgaaggataccccactcccagacaccagcttgagaagattcccgcacggccggggacggccccagggccttgggagcgtctgtggacacctgtggtgtgggccgaggagctgggagctcatctgaacacgccagcactcgcgcatccacgctgctggcggatgcctgggtttctccactgtggggccacgttacatgaagtcgctgtggtcattctcattcagatcccaggactcttaagtgcgcaggagtgggacggccggggcccagggtggacagaaagttggctcaagcagaaactgtggtttccaaggtgactgtccccctggacacctatggcagggacataggggccgtgtgggccctttgcagggactcctcggggtgctcaggggccctgggacccccttccaggtgcagcaaggggtgggcgtaggtgtggaggggaagaggggcaggtctctacactcctcctccaaggacacagagccccgggggtcagccactcccaagctccttgggcaacccggggctcaggggccagctgcccttgtcagcgcctggccaggaacctccaccccaggcagccttgggcctgagctttcccagtctctccccccgctccccactcaatctggaactcgcacccagggaccaacctccagggtcccacttgaccccgctaccctcacctccaccctggcccaagacccctctccagccacaggttggcacagcccaagtctcccaagacccctctccagccacaggttggcacggcccaagtctcccaagacccctttccagccacaggttggcacggcccaagtctcccaagacccctctccagccagaggcgggcacggcccaagcctcccaagacccctgtccagccagaggcgggcacggcccaagcctcccaagacccctctccagtcagaggcgggcacggcccaagcctccatgccacaggtgtgcagcccacagtgccggtcggagactcccgtctgccaaggtttttattgtggtcccgcggggcaggaggtatgcatggcatacgtaagcagagagccggaggcagccatcggcacctagaacggtgcagagttggcccaggagcgtggcggggcaggcggcctgcacctgccctgctcgcccagcagaccctccgggctccagcctggcggggcccagcgtccaccttggtgggcccaggtcagatcttggccagggtggagtgggcgtcggcctgctcctcttggatgggggtccggaaactgcctccccctggggaggaaaaaaggagagattggtgggtgggcctcacccgccaggagcagtgcggcagggccatgaggcactcaccagggggcttgtgggcatcggggggcagcctctggtccctccggagcaggtacagggccagcaggatggccagggggcccagcagccccagcaccaggcccaggcccaggatggcggcaaccgcacggcctgcaggaaggggtctgctgggtggggtccacaggaggggcccccatgccgccctccccttctcctattcgggttgggggccccgctgggctgggccaggcgcccttacccccggggacctccacgggccgggtggagggtccctgtgaggttctgggccaggcttcagtgggctggacagtgatgggcctggccggggggccctgggtctcctggggctgcgtggctggggggtccctgtcctcacagattgcgtccgagctattgctggccggctgcagggtgtgcttcccagccaaggtgcagctgttggggaacaggaggtgttgctcaggccagaaaccccctgggacccgggagatgcggtggggataacagggtccacgctggccagccacaggcagcatctaccacagacaccaggccagtgacagccaaggacgctgcccagccccacgtgccccccacaggggcctccaaggccacacacccttctcccacatctacaccccccaccagcacctccctgtcctgtgcccccagggcctcccagctgcggagggtgagggtcccacacacccagctccacccacagggaaaggctgcccccaggcagcagcttcctgctccccaaccaggtccagccacatagccaggcccccagggccaccagcacctccccttcccccaaaactgcccccaccccacctgcccccccagcccctcccagctccccagctcctccgccctcctaaccaccccaacccccccccagcccctcccagcccctggccaggcccctcacttggtccagggcttgcaggcctggttgtcgcctggggagaagtgccctggagggcagggggcacagtctgcaacaaagatagggtggtcaggggctgcccacaggccccgggtgctggggacatggggcagagcctgtggggcaggcacttgccccccatggctgggtggtgggtttggcctctggaagccctccctgcccacatcccacccgtgggccctgacccgggagctcggtcttgaggatgccagaggaggcaccggtggggccaggtccctgcggcccacggcccatctgcgtcacagacagccgctatgcacacccccaaccgccggccgcagccaccgagctcaccaactccaggcttgtagctgtccaggggctgggtgcccgcccggcagcggcagactgtgtcctgtgtggccgtgcacagctgcttccgctcactcccacttcctgagcaggggccggatgggggggtggtcaggtgggggctgtggacagggtcctcaggaagcgtgggcactggaggacaggttggcctccccaccacacagagggccgtgggcaggggtctgcggcctcccctgagacttggagcccctgcagcccccgaggctcctgggccctcccttcctggccacaacctggggctggttccgtggcagccccagccacccttccctacccctccaccgcctccagccgccagccccgcctgcggcagggtctccatggcccaaccccccagcctcactgctcaggccagcaaggccaggccacatggccagcgtggtctccccgactccacgtggcctgggccgagtctgggcccccggagggagagggggtgcccctgggagacgcctcagctcctcgaaggacccctgtggcggagcagaccccgctgtggtttgaggttcgtttctgcggctgtgggagccccatgctgctgcgtgggaatgtgggtgccaggctgccgccccctgtgctgggtggggctgtggggccaggtgggagctcactgaggttacaccacgtgcagggcttgcacggcttggagctgaccacgtcgttgtagaagcccggcccgcacggacggcacaccgtgttctgggagcggctgcagcggctcaccatcccgttgcctgcagcagaggccggcgtcaggcagcggtcaggccccaggcttgcgcccgtggacccccccaggcggctcctctgccaggcttggccggcccctcacccgccccctccccaggaccagcctcctggctggcccatccctgccccagcccccagtccctggagtgcccgtgcgtggcgacccctcctgaggcctcacctggcctgcactcgtggcagcaccggtcgttgctggggtaggtgtccccgacacagtggagccccgtcacggtgctcagccccaggcccaggaggagcagagccgcacacggcccgcggcccagccgccgagcccccacgcacatcctcgtctctgctgtcgccagagtctgggttttccttgcggggtgtggctataaggactgtggaggaggggaggggagaggggaggagggcagaggaggcgggaggaggaaggtggcaggccggggaccctggctgtgggctgggcacaaaggcggggtctgggcacccccagcattggcttattctgccttctgacctcttctgcccaagaccaccgtgttcagaccccagggcacagtagggcctggcctgcggctcgaccctcagcaaaaaggtccatggagcacgtgggtaaactgaggcagcactgagtcaggagaggcaactcctcagtctggaccttcagggctgtggcactgctgaagcatggtcccccttgtatgcccaagactagctctgagcagcagtgaccacagccatggtaagacagacacccatggccaggcacggtggctcccgcctgtaatcccagcactttgggaggccaaggcgggtggatcacctgaggtcaggagttcaagaccagtctggctaacatggcgaaatcccgtctctactaaaactacaaaaattattcgggcgtggtggcgggcgccggtaatcccagctagtcaggaggctgaggtagcagaatcactcgaacccaggagacagaagttgcaaagcagaggtggcgccactgcactccagcctgggcgacagggcgagactcatctcaaaaaaaaaaaaaaagacacccgtgaccacagcccacgctgagtgtgcctgagcacggcaggtgtctatggctgaactgtgccccttaaattcctgcgtggaagccctaacccccatgtggcagtgtttggagacaggcctctgaggaggtggtgagggtgggtcctggatggcctggcgcacacgggcacgcaggcaggtttccaccttctatgcaaacagttctcaggttccaggtttgcccagaggatgcgaactgcccggagagctggggagcaggtgcggggctgggggctccctgggccctttctgcacctttcaaataactgtgaccagcctgtgattatccaaaagttcatttttgaagttgcaagtggagaggggcctctaggaacagagcagcagggaaggggctggaaatcccctcctcccaggagcacaggaaacagctgcctgtcctcggcccacccgtggggaaattcccagccgtggagcccgctggccctggagagggagggagtggagggagaggccacccgccctcggactgagggtccctaagttggtcaccctccccacgtccccacaagtagagaggaccctggaagggctcagagcatcccagacagtgtgtgtacctgcatgtgcacaccccaacccaggtgggcagaggaggaaagttctggcattttgtggaaggttccacccagcgttcacaagggtttcccactgacagtgagaaaaagcttacatttgcaattggttccttggaggttcaggtgaactgggggtcttggtgggcaacactgctctcctggggcctaagtggccacatctgcccacaggtgcagtgagtggggcccgtgcaccatggagagggcacccccagcatattgctggcaactgcaatggccccaggatggggcacggcccctcctgcttgaagctgcccaggaagctcaggtctccttgtcctgggcttaaggtcacaggtccaagaaagccctgctgtgtccatggaaccgggtgtggcgtggccacaggaggctggacactgacccagagctcaggacccccaaggtctgtaaggcag

SEQ ID NO: 337 - DNA, 784 bp, Homo sapiens
  CpG Island of TNFRSF4
ctcagctcctcgaaggacccctgtggcggagcagaccccgctgtggtttgaggttcgtttctgcggctgtgggagccccatgctgctgcgtgggaatgtgggtgccaggctgccgccccctgtgctgggtggggctgtggggccaggtgggagctcactgaggttacaccacgtgcagggcttgcacggcttggagctgaccacgtcgttgtagaagcccggcccgcacggacggcacaccgtgttctgggagcggctgcagcggctcaccatcccgttgcctgcagcagaggccggcgtcaggcagcggtcaggccccaggcttgcgcccgtggacccccccaggcggctcctctgccaggcttggccggcccctcacccgccccctccccaggaccagcctcctggctggcccatccctgccccagcccccagtccctggagtgcccgtgcgtggcgacccctcctgaggcctcacctggcctgcactcgtggcagcaccggtcgttgctggggtaggtgtccccgacacagtggagccccgtcacggtgctcagccccaggcccaggaggagcagagccgcacacggcccgcggcccagccgccgagcccccacgcacatcctcgtctctgctgtcgccagagtctgggttttccttgcggggtgtggctataaggactgtggaggaggggaggggagaggggaggagggcagaggaggcgggaggaggaaggtggcaggccggggaccctggctgtgggctgggcacaaaggcggggtct

SEQ ID NO: 338 - DNA, 1068 bp, Homo sapiens
  cDNA TNFRSF4-001
cgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacgggagtctccgaccggca

SEQ ID NO: 339 - DNA, 393 bp, Homo sapiens
  cDNA TNFRSF4-003
cccaggggcaccccctctccctccgggggcccagactcggcccaggccacgtggagtcggggagaccacgctggccatgtggcctggccttgctggcctgagcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcc

SEQ ID NO: 340 - DNA, 1707 bp, Homo sapiens
  cDNA TNFRSF4-002
cagagacgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagtgagctcccacctggccccacagccccacccagcacagggggcggcagcctggcacccacattcccacgcagcagcatggggctcccacagccgcagaaacgaacctcaaaccacagcggggtctgctccgccacaggggtccttcgaggagctgaggcgtctcccaggggcaccccctctccctccgggggcccagactcggcccaggccacgtggagtcggggagaccacgctggccatgtggcctggccttgctggcctgagcagtgaggctggggggttgggccatggagaccctgccgcaggcggggctggcggctggaggcggtggaggggtagggaagggtggctggggctgccacggaaccagccccaggttgtggccaggaagggagggcccaggagcctcgggggctgcaggggctccaagtctcaggggaggccgcagacccctgcccacggccctctgtgtggtggggaggccaacctgtcctccagtgcccacgcttcctgaggaccctgtccacagcccccacctgaccacccccccatccggcccctgctcaggaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctggtgagtgcctcatggccctgccgcactgctcctggcgggtgaggcccacccaccaatctctccttttttcctccccagggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagacggga

SEQ ID NO: 341 - DNA, 6852 bp, Homo sapiens
  Coding Sequence of the CD27 Gene
aatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggtaagagggggccttggtaagggccaggtgagtggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacggtgaaaccccgtctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcacacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 342 - DNA, 5437 bp, Homo sapiens
  1st Promoter of CD27
atgccccagccaggcatgggggagaggctgaccccaaaagagaaagtggttgtgtgagatttcaaggaagatgtcagcgggctgcatcccagggcctctagacaaaaggaagggcccagccaggcatggtggctcgtgcctgtaatcccagcactttgggaggccgaggcaggcagatcacctgaggctaggtgttctggtccagcctggccaacatgacaaaaccccatctctactaaaaatacaaaaaataagctgggcgcggtggctctcccctgtaatcccagccaaggtgggcggatcaacttgaggccagcctgaccaacgtggcaaaactccatctctactaaaaatacaaaaattagctgagcgtggtggcacgcacctgtcatcccagttactcaggaggctgaggcgtgagaatggcttgagcctgggagacagaggttgcagtgagctgagattgcatcattgcactctagcctgggtgacagagtgaaatggagggaggaaaaaaaaaaaaaaggaaggtcccgtccagggagccagcctaggatggggaaggctcaccagaagtggatgcaaagagtgctggagatgagctcattctatttgcctaggaaagaaaaacgtccagaaacctggccttcctcctcttggccgaggccctccaggaaagccaggcagaccctgctcctgctctgaccccctggagaagtgatatgtagaaaagaggagatgggctttggcccagaggacagcagcgttaggctagtgagcagttcccagtcggttcaaggttgctaggctcagcgaactgcaagtccctgttcgacaagtttcttcctaaaggtccccagttcctcatgattcttctgagggtctcatccaccctcccagggcctgcagtcagctagccaccccactgccccatgcctgcagtgaacacatttaccacaacctggaaatggctggtgacagaaaagtcctcacggccacaacactctctgcggtgggaattcaggtgccttgcctgatggtgacaaagctggttttgcataaacagctctctgaatcacacccaaatgtggcttctgacttgagtggacccccatgaagagctgcagagggggctgggaaaagacaagagaatggagaaaatgaggagaaaggaaactacagagtgagatagagaacagatctgacaggtgtgaccacagcagtgtgacatttatgaacagtgtggaaacaacggcaaagcccctaaattaaaaacttcctggggaaataagccactccacatatcggttgctgaggaaagagtggaggaggctgttgacccgtgtgtgtccccatgactcaaagagggaaaagtctagctgtttccaatatcccgaaatcagtcttgctgggagaactgggaaaataaaaaagagatgacccccgtaggaagctacctttaatcccaagtgcccaaggctaggagagaagatgctccaggcgatccaggacaccagtgactgacacagccagaggtgggaaaggggaggataaagatggcacaaaagtgaggagtgagcaagggtctgagagggaaggccatgtgggcagtaggtggcacccacatcagagactgacatgaggattaaaggagagcataggtgatcggtcagagtgtgacagaagagaggcagctctacaccccttgcttgcaattctgagcattctgtagcaaactcgtttggccatcaaaccagacctcaattgagacaaggctatttaagcttcctcccagttggtgtaaatattcaatagttttgctgcagaaatgttgcgtttgattatgagactaccccaactccccaagggtgttttgtggtgctggtttctgtataaacctgaaaaattctgaattccaaaacttatctgacccccaaagtttcagataagagcttgtggacctgtgctcaattctggttctccttccttctttcaactgttgtctgtgaaaggagggatgcaggtatgggagacaggagtcctgcgaattcgtctgtaaactgtggacgggggggtgggtgggggggggtaacgtgggcacctttgtgcacaagtgcatgaataggaggggtgagcaactgtgtgtccatcacctttttgtcaaagaagcaggagtcagtgggctacgtgcttcatgagcaggagaggcggaaactaaggaaggctcatgtgttggaggaagcatgtttgaagagcagcaggtctcacagagtttgctctttaatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggtaagagggggccttggtaagggccaggtgagtggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtcctta

SEQ ID NO: 343 - DNA, 4914 bp, Homo sapiens
  2nd Promoter of CD27
atactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcacacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgcagctctccagcttcctctctgaaatcccagtcccaaaatccagtttcctggccgcctcctggctcaggtcaggatctggcagaggaggtttctcagccggttatgttggggcctgcttaagggcgggggtgagaaaggtccccaggctactgtggatcctgtgtctgacttcagatccccttttcccacagttatagctccacttttttgggacaggtggggagcaaaagggtgcagaggtcaggtcttgaaatcaccaggggatttccgggtgaggtgggtggtgagaaaggaaacagcaagcagggctctggcagctgctgcagacggcttcacacagggacgcgggctgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccagtgagtctgggagtcggggagagctggctgggagaagagctactgaagccccagggtgccaccctccccgagattccagaagagcaaaggggccggggatgaccccatcgccttctaagcccaacaggggaaaggctcagcggctggcaaaggaaggaaccaatagtgtgtgtggagggagggtggggactccacagggaaaatgctaaagaggggctgcctctgtggctgtggtcaggagccactgtcctacagagagggcactggcctgggagctgacacttcagaagaggaaaggactccccaggtgaggaaatcacttggaaggtgaccttgaaggcgggggaggggaaggctacccgaaatgggagaaagcagtgcaggctgtcagtgccccagcaacagtaactgtccagtctcctctctctgcggtggcacttgcttgttttctgagaattcctttgactgaaaagatagtcttttattcaacagttggaaatgcaagcataaactcctctgagcaaggcaaatccaggactttaactctcaccaagaagtatttgcctggactagcaggtgctctccagaaagctggtttggggatgacgggagaatagagggacacagaaacagctaggatcttggatggcaacttttaccctttgatgactccacagcttgagggcgggggcaggaagcaagtgtggagtagctttctggggaaggcggtgctcaccccagcctttgtctgcagagccccacccagcagaggggcagtggcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcaggtaaaagccttccacctgtgtccttggtcctcccgggctccctccaccaggacagcccaggtcccgattacagccacacatactgcctcccgttggccctggtgttctcacgctaatttgccctctgtgtgtgccctgcttctccccagtggacctggtccagattccccaggccgaggccttgctccatgctgactgcagtgggaaggaggtgacctgtgagatctcccgctactttctccagatgacagagaccactgttaagacagcagcttggttcatggccaacatgcaggtctctggagggggacctagcatctccttggtgatgaagactcccagggtcaccaagaatgaggcgctctggcacccgacgctgaacttgccactgagcccccaggggactgtgcgaactgcaggtaagaaaatgaaaagcaaggccaggtgtggtggctcacgcctgtaattccagaattttgggataccgaggtcggtggatcacctgaggtcaggagtttgagatcagcctggtcaacacggtgaaaccccgtctctactaataccaaaattagccgggcatggtggcgggtgcctgtaa

SEQ ID NO: 344 - DNA, 2275 bp, Homo sapiens
  1st Enhancer of CD27
ggccaggtgtggtggctcacgcctgtaattccagaattttgggataccgaggtcggtggatcacctgaggtcaggagtttgagatcagcctggtcaacacggtgaaaccccgtctctactaataccaaaattagccgggcatggtggcgggtgcctgtaatcccagctacgagggaggctgaggcaggagaatcgcttgaacccggaaggcagaggttgcggtgagccgagatcacaccatggcacttcagcctgggcaacaagagcgaaactccatctcaaaaaaaaaaaagaaaagaaaagaaaagcaagtcacagaaagttttgcttttctaaagtggtaagatatggggcacagaagaagaaagggaacaaatccacctccatccacactggtcacctcagggcacccctaggccttggtcctttcttcctaaaaacccctgagtcaggccaggtgcgaaggcccatgcctgtaatcccagcactttgggaggccaaggcaggtggatcacctgaggtcaggagttcaagaccagcctggccaacatggtgaaaccccctctctactaaaatacagaaattagccgggcatgatggcaggtgcctgtaatcccagctactcaggagactgagacgggagaatcacttgaacctgagagacggtggttgcagtgagccgagattgcgccactgcactccagcctgggcagctgagtgagacaccgtctcaaaaacaacaacaacaacaaaaaccctgagtccacaagagaatgcttcgcagcccctacctgaacgtccccaggcacacagacaacctgtgttatttccaaaatggagatcgttctcatctcactgggctgccatgaggaaataagacacatgatgctattctgtacatgggtgctgtccactgtagtcttatcgagccaaaacccggttttctcccagtgaaatgctaggctgctctggtgcttcaggggtaaagctcagggatgcatcatttgttcatgatcttattagtaaacccagtacttgccctctccagctcagcacatcctcgagggcacaagaaattgagaacatgatgacagggttccccagagcccattaatccaatactctgtgccctgcttctttgagtctccaagaagaaacagccaagtccagagaaaattaggggcaaccgtcctatccttggaaaaccccagaacactctaacctctctgtggtccaacctaaatctatcctgacccattagaaaaaggtcttcatgtctgtccagtgtctaccatactcctggcatgcgtaggtatttctctctttttattccaaacctacaaaaaaaggtgaaataataatataatgaacacctatataccctacacctagatccaccagttgttaacaatttgccacattctctctcccccgactcctcatgtgtgtatatgtgtacgtgtgtattttcctctgaactgagagtaagttgcagaagataacacttgaaccccaaacgcatgtttgaaccccgaaacgcatgtttaaaccccaaatacatccatagcatgtattagtttacaatgaaggacaaggatgtaatccttcatagttacaaagccatcatgtcagaaacaaaccaaagtggggaagtagtctacccgtagcgcaggcaataagggagtgcagactgtaaaatatttcagaacaaaaataaaatcagctaaaagtcagatggctttatagtctcaccatctcccgacactggcaattctgaatattatcagtgataaaatactcctctctgctagggcagactgtccctatctccccacacgactgcctagtatgccacagatcttcatacttttagatattttttaattgatatgataatagtctcaactataaagtccagggcatggtggtgcacacctgtagtccagctactcaggagactgaggcaggaggattgcttgagcccaggagtttgagtcctgtctgggcaacatagagagcgagaccctctttttttttttttttttttaacagtctcattctgtctcccaggctggagtgcagtggcatgatcttggctcactgcaacctctgcctcccaggttcaagtgattcttgtgcctcagtctcccaagtagctgggattatagacgcccgccaccacaccagctaatttttgtatttttagtagagatggggtttcaccatattggccaggctggtcttgaactcctgacctcaggtgatccacccatct

SEQ ID NO: 345 - DNA, 1957 bp, Homo sapiens
  2nd Enhancer of CD27
tcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacggtgaaaccccgtctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctca

SEQ ID NO: 346 - DNA, 3623 bp, Homo sapiens
  3rd Enhancer of CD27
tacatgctgaaaatcattttattgatggggtacaaaataaaaaaaaaaagcagagactactgaattagaaatatacattttttcaggcacagatggaacatttacaaccacatactaggccatagagcaaatctcaaacaaatgccagaggattcatatgtattcattttctacagctgctacaacaaattaccacaaacttagtggttgaaaacaacccaaatgtattatgttacagctctacaggtcagaagtctaaaacaggcctcaccaggctacaatcagtgatggcaggtacagctgcccctggaggctgaagggtcaaatccatctccttgccccttccagcttctagaagccgcccacatactgaggctcatggccttcttcttccaacttcaaagtcagcaacatcttgatccttctcatgcagctgcctctctggcgctgtctcctctgcctctttgccacttacaaggatgcttgtgattacactgggtctacctggataatgcagaataatcacccattgcaaggccaaccttgattccatctgcagccttaactcccctttgccatattaacatgcagttcaggggcgcagatgtcctcgggggaccaacgtgctgcctgccatgctacacagacagagtgctcgggccacaataaatttaaaattaaaataataaacaacaaaaagttaagccccacagatctggaaaatttgtaatgcatttataaatgaaatataggtaaaaataaataataacgggaaaagcaaatcaacaataatgaaaaaaacaatatagcaaagctgatgagatgtagctaaagtagatcttcaagggaagtttatagccttaaatgcatatattagaaaataagaaatttctaaattaattaagcatccaatacattagaaaaagaatggcaaagtatgccgggtgcagtggctcacatctgtaatcccagcactttgagaggccaaggtaggtggatcacttgagctcaagagttcgagacaagcctgaccaacatggtgaaaccacgtctctactaacaatacaaaaattagccaggtgtggtggcgcacacctgtaatcccagctactaaggaggctgaggcaggagaatcacttgacctcaggaggaggaggttgcagtgagccaagatcatgccactgcactccagcctgggcaacagagcaagacagcctaaaaaaaataataataataacagtgaaacagctacacacaagcaaatcaagttctaccaggctttcaaggaacagattatccctattgtatataatctgtatataaaaaaataaaaaatagcacttaaaaaacaagtggtcaaagcaaggaaaatagaatcgtgtcacagaaaccaagggaagtaataattctcatgtaggtggagagctgccagatcccacatatctctgttaaactttgcttcctggatgaggcactccctaccccttaaatccccctattaggggtatagacacctatattgcaccccaactctctccttcatagcaataatgaccattactaactaattttaattttgttttgttttttgggttttgtgagatgaggtcttgctctatctcccaggcttgagtgcactggcatgatcatggctcactgcaacctcgaccccctgggctcaagtgatcctcccacctcagccttccgagtggctgggaccacaggcacgtgccaccacacccagttaatttatttttattatgtgtagagacggggtgtcactctgttgcccaggctggtcttaaactcctaggctcaagcaatccttccgcctcggcctcccaacgtgactgggattccaggtgtgagccgcctcacctggccaattttacatttgtctttgagattatatgatcgatgtctgactctcacactggtgtgtcaactccgtcagggcagaaaccacatatttgtctgtttgtttttcatctttgtgccccattacttggctggttcctaacacaaaatgaatgtgcaaaaaacgcttgtcaaatgaatgaggaggtctaaggggccttgagccctctgacgtttccattttataattgtggacagagccgctacagcacaaagctgagctggaccatccaatgtttagccagtgccttacgtgctaggagacactgggagctgtgctgggcttctgaggagtgggcagaggctggaaatacccatagttggtcagtctcctgtgtcacccagactggggaggtgcagaaatgaaaattacagagctgcgaggacccagaacctcattaatgagcttaactcactgtcctgaccaggtggcctctcaaagccttgctgggaaggaggctttaaggtggtgggggcagcagtgctggtggtggtcatcgaagaaagtgggagtcggggaggaagcaatggggagcaggggacaaagagggccagacaaactcagagcttcaggtgatgagactcaggaagcctaagtcaggaacagtgattgcggacatctttgtcccataacagaacttcctcctaaggaaaggtcttgcagagactggtcctgctgagcgctttaacaggttattgattcataaaaattggagaaaaaagacaaagtctgccacacctaacagccttctgtttagagctggtttagaggaaactttaagcaagtcttgtgtccaacaatttgggcctgaggcagggtacaggtaagggaacagacaggagacacggaggcaagaacaagactttagctgaaagagaaatcagagccagaggcagccacaagaacacccaacctactggaactcatgcaggtggacagcctgcccaggacttgccctgagtgggaagcaaagagcatcttatctagattttaaggagcagggtgcccctggctgacatctaggctacagtcactgggccaggtggagggttggtcaggccctctcaaaagtcatgagaggccaggcacagtggctcacgcttgtaatcccaacactttgggaggccgaggagggcagatcacttgaggccaggagtttgagaccagcctggccaacatagtgaaaccccgtctctactaaaaatacaaaaaattagccgggtatggtggccggtgcctataatcccagctacttgggaggctgatgtataagaatcgcttgaacctgggaggcaaaggttgcagtgagctgagatcatgccactgcactccagcctgggcaacagtgagagaccctttctcaaaaaaaaaaaaaaaaaaaagaaccaaaaaaagtcatgagagtcctcagagttctcaagaagggctgctgtgggcctgtttctggaaaggaaagaaaagcagggagctgttgagaaaataccatatgtttttatgccccagccaggcatgggggagaggctgaccccaaaagagaaagtggttgtgtgagatttcaaggaagatgtcagcgggctgcatcccagggcctctagacaaaaggaagggcccagccaggcatggtggctcgtgcctgtaatcccagcactttgggaggccgaggcaggcagatcacctgaggctaggtgttctggtccagcctggc

SEQ ID NO: 347 - DNA, 1338 bp, Homo sapiens
  cDNA CD27-001
aatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 348 - DNA, 1045 bp, Homo sapiens
  cDNA CD27-002
gggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 349 - DNA, 4469 bp, Homo sapiens
  1st Promoter of LAG3
ggacagggggaggtctcccctcccattttacagctcccccattctctccctctccacaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaacctgtctcctgctttcccgggggctccagtcagtgcgacaaaagggtagagagggaggagggtggctgacctcccattctgccaggacccttccctttgatacaaaagcagcagcacactcctaccacccacgactcaagaagacaagatcagccctccaggggtggcctggagcccagctcttctgagagctgacttatgtcctgttttggattctcagggatgctcctccccagcaatacacacttccctgctaacccacacaagacctagacactgctgagcccagtggaaagctaccagctctattgtgctgaaccaggcacagagaaacagcccagaaacaggaagtccttcccctgagctgggagagggctggtagtcctgggtctcagcctgctaggatctggagtgagctgcctggcatcagagatgccctctgcctggcatggaagcgagctccttccagtcaagcagggaaatcctgggtctcgtgtcatccccaggtcggctgtatgtttcgtcacctgccctccaactctccctgggctgggctggggagcgggagttgtatgactcttgtcagtcttgggccttccctagtcccactgcctctgtttcccctgagtttgatctctgttaggagatttctaagatttctgcatttctccatctccgcatggcccttgccttctcctcttagttcggaacctctggactggaggatgcttctgagggcatggggacctgagttggagtggggaggggtgttgactcatcaacagcatcatttctcccaggagacgcccgtaactcatccaaggtcaggactacacactgtcacgcacacaggtacactcacagcttttatcttcacgctccctaaccttggcaaattgtacaatttctttgaagctcagtttcctcatctgtacaatggggaaaagcattagatttcatgaattactataagtaaagtgtccaatacagtgcttagcacgtaatgaagcctcaatacaatgtagttattctccatgccccacaaagctggcatgcctagcctcagacctaccattttttggggtgcagtaaggcttcctgtccaccatgttcccagggacattgtactgatgggtggaaaggcaggtctaaaggggtcacgaagttctgggaggttaagggaacgaggaaggagattgagcaacaaggaaagagcttgccaagaaggaggtgtgaatattgggactgaggaggcagcttagagatgggcaagggggcagttccaggcagaaatggttcgtggaggcagaaggtccctgggagagggagcagtctggagggtggggcaggggcgaggagggggaggtggggagacccaggactgaggaagtaaacaaggggagcgccaccacagaggtggagaggtggagggtgctgctgctgggaatcaaccccctcagactttccactgcgaagcgaaaccgtaagccctggggtgcggggggcgggccgggaggaggggaagtggggaaggtggagggaaggccgggcacaggggtgaaggcccagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccaggtaaaacggggatggcgggagggttgacctccagccccacaggaggggaccagcagggatctctgtggccacaaaggtcctgaggtccttagctctgtggattcttctaatcccttttttgggcagtccttccaccccgaaagcctctctgggcagagaagaaacagaaacccaagttcttcctgcaccctgtttctccctcgggaaacacccaggctccttctctacccctgcctctcggctcacgccccctccccttggcctctcttttgctcacctagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacaggtatgcaccccaaacttgggcaacaggacctccgaatccagcactcaaccccacacccgtgccggtcctctgtcccctgccctgaggtgtcactccctctgaagccagtgacccagtctccctgccctcgcttgcaccgttcctgcccttgctctgcaatcagcgaccctcacgccagcatcccttctctccagaagtggatgcggccagtccaacagaggggtcgggcgtgaggggacggttggtggtcaagagaactcttggggcgggctttctcatcctcaacgggtggctgcctgcatcctcccgggcttcctacccctggagcttctcaactccattctctttcccgcccagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgagtatgtggggcgggacgatgggagaagggctgggaggtgggtccccatcccctgcctcccgggacgcaggaagggctggggcagaggctgcgccctaggccctgtcggagagctcccagaagagtagaggaagggggtgggcggcctgctggagtggaaggtgcccccgaagcacgtgtatggggggccctgtggagagattgtgtcacccccgagctccccttctcccacccacgcgggagtgcccagagggagggggagggggggagagcatggggctaaagtgattcatttcagatatctgtagctcagggggtgggcttcgcggggttccaggccaggaaaacggcaagggtggctgatgccaagtaaactccaggccagggacggggaaagtggtcctggggagtcttggggatccactttatgcacctccaggtgctggaagctgagatggggagagggtgatgtgggagaggagaagacaagtctaaagccaggtgcctgtttccaggagcttccggcttggcagccctgctgtgttgggaaattgtttccagtgggctgatgaagtcttctttatccttgcacagtgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggg

SEQ ID NO: 350 - DNA, 3553 bp, Homo sapiens
  2nd Promoter of LAG3
ctcatcctgtactttctccataggtgcccaacgctctgggagagccccaggtgccctcccagcaggccacctcctgctgtttctcatccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctctcactccagggatggcttgtgcctgggtaggctggaaggggggttgggagaaagccaggaccagatggggagggcaggggcgctgagaaaaaatagagggactcagtgtccctcctcatccgcttcccttcatccttctcctccttccgccctccgtctctctctccatctcttctcacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaagcctgagtctggctctttcttgtccaagtgaaggttcccgtctctccccagcctctgagggctcccttctcccaccctagcctcctaacctactttccccagccagcctccctcaccttccccttttctgtttctggctgcttcgtgtttctttcttggtctctctctctcttgcgctcactctctctttctctctcctgggtaatcatttctctgaagctcccccgaaaaagcccttgccccttgcctccgcagctctctcctccgtccttccacccaccttccacccacagtgcgctggctgccctggtttccttgatatttttgtcctttgggtccaccccaccccacactcagctgcacttcagcacttgtccttggccctccggctgcagcagatgcgcacatatgctcgcgcgcacgtgcacacacacatgcacacacacgcgcgcgcgcacacgcacacacacacacacacacacacacgcgcggcgcgcagaggactgccttgtcaagtcttccaggagatccggtctggaaacctctctgggcagccggctggggctcctacctctgccccaccccccacgttcctcagcccttggaggcttttctggtcccaggcatgagaacacactgccacccagtggtcactgcttgtcacaccccaacggaggtcactgggccggctgcggcaggcctgaggagttgagcagtgcagtggacaaggcagggcacagactgctgtgaatgcaggcaccgcctttgtattatgcacgttctatgtgcagcatatgagtatgtgcccggtgactgtcacatgtcctatgcacccttcaggagagggactgaacaatgcatgtctcaggagatacagccctggctggccctctcaagggtgtaatctatgtctgacaaaggggaaggctgtgaacaaaggcctgtgcgtagagcaaaacagccagctgcagctgtgggagtcgggagccccggcttctcattccagctttgctgatgtaactgtagtcaatctccctgagcctcagtttcctcacctattaaatgggataatgataataacccaccaaaatgggttgttgtgaatattggataataaagggctttggaaactgtgaagtgctctgtgtgtgtggagtacttgtctgattatccattagtgaaggagaaagcaggcctgctctggtcatgctaagaatgatattgaagaacccaagtcggcctgcgccctgctctgtctgtctgtcttggagcattcacctgggccatgtcaatggtcctctcagcagagcaaacacggcctcagcacatggcatcctccagtctggcatgggacagagacctctgcctgcaaataggtgtggggccctggactttggccacagatgactctgtcaggggactttaaccccatacaggagaacaaaatattgaaagcgagtgggtgagtgggagtgaaactgctggagcaggaggggcatggtggcatgtgtgagtggcatcccactgggtctgtgtgccgtgtgcaaaaagacacaaaaagacagacctgaggacatgtccctgcagagacacaatagtcactcattagagacagacgatgaagaaggtgacacctttgttctgtgcagagccttaggtagaggggggaccctctgaagcctgaacaatgaaccatttacagcaatctgaggttctgagcctcaggatggtgatgactcttgccttgtcactggcagagaaacactggcacaggaaggaggaagctctggccctgccagagatgatcacactgcaaaaggaagtcttgaagtccttttagaagcttccaggccaggtgtcatggcttatgcctgtaatctcagcactttgggaggcggaggcagaaggattgcttgagcccaggagttcgagaccagcctgggcagtatagtgagacctcatctctaaaaaaaaaaaaaaaaagttagttgggcatgctggtacgcccctgtggtcccagctatttgggaggttgaggtgggaggatcacctaagcctgggaggttgaggctgcagtgagccataatcgtgccactatactccagcctgggtgacagagtgagatcctgtctcaaaaacaaaaaacaagaagcctccaaagcatcgttcctacccttcgctgctgctcagagactcctcagctccagcccaggaccctgctccccacagccttagtggaagccctgatattttaatagggcaggggtttcctggaaagttctgtgggtggcatttttcctttttactagctaacatcctatgccctttgggcttatgagagtagtcatcgaagattcactgaggcctatgcggggacttccccatgctctttcataaaggggacagggaggggacagaggcagaacgaagggcctcctttttcctttaccccttagagaagagcaaagggcagaaggaagaaagggcatatgggctgcattccgtgagtgcttctctgtggggtctctcctcagggtgacattctgctcccactcctcttcccacagccccccactctccgtctggcaggataatctccagcccttttcctgtcctccaaaggcccctagggagcttggttaattcatttggcttctccaggttgatctgtaaaccagtgttccaggctgcggtcctggaggggaaggagcatcaggaggccacgagctcagggagcttcagtgggtgggtgggtgggaatcatctcagctccttgttaagaaggaaggggggtgcgtgagttacctattggcgtataacaaacaaattaccctaaaacttagtaatttaaaataataagctggg

SEQ ID NO: 351 - DNA, 3378 bp, Homo sapiens
  1st Enhancer of LAG3
attggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtaactcccccactctgcttcacatttgaccacaactccttcctgccccccttgtcacctcccctaactatgggtccccaaaccaggttctcggcagcgagtggcctacgtcattgctgtgggtctcactgttcgacccctttatattgctggcagcctcacagctgccatcaccccttcttgcttctcccgtggccttccagcgtcattgccggccttccctctccttccggctaagcccacttgctgggtttctgagcctcctcagctcatcaccttattctgctccttagcactcttatgagccagaccatctcctgaattcttctgcctcccttccttgcagccccagcactccctccccactgcagcacccagctttaactttgggttttcttttctcttcaggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacaggtcagcctcaggtgggaaaggagtagctgccctcccagggtagaaaggacagggaggaagggctggcagggcaaagactaggcaaacccaccctgtgatgccaggccactgggcacaagttccagagcctgcccatctcggcccccacttttctcacccccataataaagaaacgaaactgaaaatctcctcttgagtcacaagataaaagttccaccgttctctatgggactcccctgctctcaattggcgggagggtctgggaagttagaaggaaaggtgacaaaaattctgaatggttcgaaagaggtagaatatatttctagaatccttgtctactttgcagccagggcttgggttagagttgcaggaagtggcctggatttgggaggagtgaataaatccgtcccttggtcagcaaatatttactgagcaagggttttccaagacagtataaaacaaacacagaaaaaagaatactcagagagtatgtgttgactggttgataactatcggccatgacagattagccatgtctgcagcacgcacctgcggccactcagtagtagcaccccacggcaggtgcttaataatgtatagagattgaatgaatacgtgaacatgctaatggataatacatctcctgaaggccaatcctgagttttcacttgctttctggatacctctaactagatgttataccacctctcagccgccttaccctgaaccccagctttttctcccaccaatccccttgctgactcagcctgtcagtaatccactggtatccatccacctcgaaacctggcctcctcctctctacatcccatcagtcatcaaagtccaccagttctttctgtccaatgccctcttgaaggtcaactgttttatgtagacggctcaatgagagagatactgttaccccgaagactttctcaaaacagctgggaagtgccagactctgggtctaaactcaggtgtctgcatcaccaaatcactctccaggacactactcagatgcccttcaccctttgtctcctcccacccacccatctctcactttacaacttggagaatgctctgtctctagatgaatgggtcagttccctgttctctataccttcagaaagggggatgatgttcattcagggggcaccacaaggcaggggacactgatgtgagccgcatcatggaagttccaaaattgtgaagtagatgggggtcagctcatctgactgattttgagggttctgagcatttgagtagaaagtaatgtaaaagaatctgtaatagtatttattctgtggtctgccagggccagtttgagtgtgaaggcagtagggagcctggaaatgttttgagcaggggagggagctgactagagcattgtctgaataagataaatgtggccggcagggcatgatggctcacacctgtaatcccagcactttgaaaggctgagacgagaggagcacttgagtccaggaattccagactagcctgggcaacatggtgaaaacgcatctgtatacaatttaataaaaaaataaatagaaagaaaaagatgaacgtggccatgacccatgatgtccttccccaacctcccctggccagaacccaagtgagtgcagggtgattgagacttggggttcaacctgtgatatcacgtaaggggggcagaatcccaaaagatctcttccttctactcttttcagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtccgaggccccagaatgccaggacccaaacgccacagcaataatctttatcctccttccagaacagcccctgccacccccatcccagcgcttttctttccagtcagggacctgatctctggcttttgcctagggttgacccgtttccgccactgatcagctgaatgaccctgggacaagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcatccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctc

SEQ ID NO: 352 - DNA, 1974 bp, Homo sapiens
  cDNA LAG3-001
agagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcatccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagc

SEQ ID NO: 353 - DNA, 1576 bp, Homo sapiens
  cDNA LAG3-003
cagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacaggtcagcctcaggtgggaaaggagtagctgccctcccagggtagaaaggacagggaggaagggctggcagggcaaagactaggcaaacccaccctgtgatgccaggccactgggcacaagttccagagcctgcccatctcggcccccacttttctcacccccataataaagaaacgaaactgaaaa

SEQ ID NO: 354 - DNA, 2587 bp, Homo sapiens
  cDNA LAG3-002
gaaggcccagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccaggtaaaacggggatggcgggagggttgacctccagccccacaggaggggaccagcagggatctctgtggccacaaaggtcctgaggtccttagctctgtggattcttctaatcccttttttgggcagtccttccaccccgaaagcctctctgggcagagaagaaacagaaacccaagttcttcctgcaccctgtttctccctcgggaaacacccaggctccttctctacccctgcctctcggctcacgccccctccccttggcctctcttttgctcacctagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcatccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctctcactccagggatggcttgtgcctgggtaggctggaaggggggttgggagaaagccaggaccagatggggagggcaggggcgctgagaaaaaatagagggactcagtgtccctcctcatccgcttcccttcatccttctcctccttccgccctccgtctctctctccatctcttctcacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaa

SEQ ID NO: 355 - DNA, 684 bp, Homo sapiens
  cDNA LAG3-004
accagggggagaggcttcttggagcagcagtgtacttcacagagctgtctagcccaggtccgaggccccagaatgccaggacccaaacgccacagcaataatctttatcctccttccagaacagcccctgccacccccatcccagcgcttttctttccagtcagggacctgatctctggcttttgcctagggttgacccgtttccgccactgatcagctgaatgaccctgggacaagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcatccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaa

SEQ ID NO: 356 - DNA, 1425 bp, Homo sapiens
  cDNA CD160-201
ctgtgcttttaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaag

SEQ ID NO: 357 - DNA, 1424 bp, Homo sapiens
  cDNA CD160-001
ccccagtctgagaacaagaaagaagaacttctgtctcgagggtctcactgtcaaccaggccagagtgcagtgaagatcatacctcactacatccgtgaactcccgggctcctcccacctaagtctcttgagtagctgggacttcaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagt

SEQ ID NO: 358 - DNA, 3388 bp, Homo sapiens
  cDNA CD160-003
aacaagatgcaaggacaatctgaggactgagagccatttcaacgtgagcccccagtctgagaacaagaaagaagaacttctgtctcgagactgaagccaaggataccagcagagccaacatttgcttcaagttcctgggcctgctgacagcgtgcaggatgctgttggaacccggcagaggctgctgtgccctggccatcctgctggcaattgtggacatccagtctggtgagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactgatccaaaggcactaaggaggaagacagataaatcagacttttcaatgggtaggaggtaagactcattaggaatgaaggcctgtgagagaggcaagttagtacaactacctctactcactgcatgaacagagggctacaagttgaagcaacagattttcagctattagaggaagaaaaggcaagagacagacttggtttggagatgggttttgaacaatgcggctcctcagcaaaggctgatggccagattgagtatattaaacacatgtagctgagtcctctgaaaaccatttaccaatatagattagcgttttccctattagataacaaaaagtgaaacttccaataatttgtcataacgtttttgcataacaagcaactgattcaggtttttgcctggccttggcattcttaactccattttatttaggcattcctcaaatcaataactaccactgttttgaatggcatcagaatgtaagctctatatatatgtaaggactttgtcttctttaccccaacgaaaagtcccacacatatggcaggctcttaataaatttgttaaaaaacctgtatgatgaatcagatgctttacacatgatgattctaaccttatacaacccttgcaagcaaacatcccctggttactcatcaggaaacagacacaaggaagttaaatagggcctggtgcggtggctcacgcctgtaatcccagcactttgggaggccaaggcaggcagatcctttgagcctaggagtttgaggccagtctgggcaacatggcaaaaccccaactatacaaaaaaatacaaaaattaggcatggtggcacacaactgtagtcccaagctaaggcatgaggatcacctgagcccaggctggttgaggttgcagtgagccatgatcatgccactgtactccagcctgggtgacagggtgagacactttctcaaaggaaaaaaaaaaaaaaaaagagttaattgttgcccgtcacagcaattaatacagatccttctcactctaaaaccttacactcagtaatgatctactatatgcaaagcacctcttacatccttcaccaccccattcattctgagattgactcctcccctttccagaaacaggaccacctaaacattccctattccagtcccttatttgcaagtcatcaaaagaaaacagagatttcaaaaagaaaacagagaccttatctgtaatccttggtaaggatcttccaaatttaagcctatgccagttttcaggaggaaacatgaatatgaaacagtctgacctttagacataattttttgttgactttaaattcccttggttaggccactgtaaccagtaaaataaattttattttagaataaaaattataaaggggaaattgagtctagccatacaacctactactagttactatctttgattcccaagtcatcctagagcaaaaaaaaaaaaaaaaaaatcatctctggcctttttttccttttccactcaggtgaagagaatgagcttttgaatccaattttttgttttctcctatattcaattcaagtagctttaaagttaaccaaaggaaaaaaccaaagctcaatatttgattaaacgagaaaatatacactacttagaagctttcttttctttatccttcttccccaactcaaggcttagtagaattattgaaagaggtagtattcagtagaatagtacacatgctttttcaggtccagaaacaccacataggtcaagttatcatgcttacatgtggggaaaaggaggagggagtttcctggacctctgtgcctctctcagctcatgaactagtttcagtgaatatccttgtcttaccactgtgccaacaattcagagctatacgtggaaaacctaccttcaactttttgagtggcatctattgcttctttgattgttccttccagcaaggagcgatcaaaggctagcccccttcccactcccaccagaatcagatttgctcaagattacaaccctaatttagtaataagatgcaatacataaaatagttcccactttccttttccaatccctttacagtcatgagggcctatcacgcacgcatctcaggacaggtgagacttcattatatcaggtattttgttgctattctaagttataaggcagtaatacaaactttctttccacagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagt

SEQ ID NO: 359 - DNA, 705 bp, Homo sapiens
  cDNA CD160-004
atgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactga

SEQ ID NO: 360 - DNA, 219 bp, Homo sapiens
  cDNA CD160-002
atgctgttggaacccggcagaggctgctgtgccctggccatcctgctggcaattgtggacatccagtctggtgagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaa

SEQ ID NO: 361 - DNA, 19818 bp, Homo sapiens
  Coding Sequence of the CD160 Gene
aacaagatgcaaggacaatctgaggactgagagccatttcaacgtgagcccccagtctgagaacaagaaagaagaacttctgtctcgaggtaaaaaggcctgctggggacctggggtccaggtgaagggatgggatggttgacagaactgctcaggtgaggacaggcttctcatgaggtccctgagaaacttgccttttggagggaaatgtcctctgccctctggagcctggggagaaggttatttctgcccgccagaccagcatgctcgcttttcttccatgggcattcaggaatcctggccccattctgacattcctcaaatggaggaattcctcaaattaccagaggaaagttaccaaagtttagatctgctggagctcttcaaggattggcctgagacaagccgggaggtgccacggggcttggagctggccctgtgaggcacctccgggggaagttcatgtcctaggtggttcacgtcatggacctcttggaggtccgtgaatagatttattcatgggatttgtgaattggggggaaaaatacatctttattttcactaatctttaattgaaagtcagcacttgcttcagttatgaatgtagacaatgaaccacaatagaatttgccatcaatagaaaacacaaatattttcaaatctcattacagtttttatagatttctccaaatgtccttaacgctcagcactactacagaattacaacagttattaggctgatgtcaaatctaaagaagcatgtgtactgctctaccacacattcttctaatgttttgacaactgtcttgtcataatttgttccctttattatcccatgtatcttattaatttttaaatgttgttctgagaagggactccatatgccttcccagaccaccaaagaggtccatggcgcctttatgtcaggcacctgctttggtgtgttgagcaggaagcctgagatctcagacaagagcttcaagggccccccagcccaaacctctgtctactaacaagtctggttctactttaaggcagttggggttgtggagattgaaaaagaagccccttcacagctgcaaatgagatctttctgggcatctttttcagtgtcgtgggagatctgtatacagaggtatttgtggagctcagagctgaccttccagctcctctgagaggttagatccgggctccggtggcagaggaaatggagactcttccttgccctcttgtccccaccctccccagaaaacctctggcaaagctttatgtgtcatctaaccgtcaccacattcctatgaggtagttttaaacacaagaggaatgtgaggctgagtgaggtccagcaatgtgctggtcacacaaagcttggatttgaacccaggagtccacaagactccaggaccgcctccgaaggtgcgggagggaagagtttcccgccgtctgtgagctgtcgcctgagagaggcaccgagccctggggccaccagcgcagctcaggagccccggggaccatcaaagatgaggatgccaactccacgggcaccctcccccctgcccgcgctggggctcacaacgttttaagaggggagacccgcccctggcgtgtagtgggcccggaaaattcccagacttctcacgaccacccgctctcccctctgttgagggccaggtgccgctctagtacatgctgcgtccccaggacccaccaggcccaactttgcaccccctcatctcccctcctagtttagactttccctggctagcccccatgctcgctggatggcccatggctggagtgacgcgggccaacgcggggcaggtagggggtcactcggctttggctgaaaggcagcgccctctagcggccagagtgcgaaatcagcgccgccggctccgcgctgccccgcctgcatcacaacagggtgctcccctcccgggcaccaaggtcacttcccagagcatccttgcccagtgacctcgctgccccccagcgctggtgaggggcccacaacagacttacatgctcttcttcaactcggccctaggcaccgcgaagtctggccactccagcggagtgaccagctgcatcagcccctcccgcctgtcctctctctccttggaagcggtccctaccctgcgcccctcccatcccgctgcaccagtcccttaggaaacacgcctagagaagggacacgaccttgtcaacattccacagctacctagtgcggagccaggactggaagccagatctcctcagcccattccccaccttaattcacccaccgtattctttagtcaccagctcccgagagcccacaaacaactatgaaggcctaacttcattgccatcttgcagcctttccacatccctcatccagaatttctcctgtgctgccccttgacactttatgaccttattacttagtacagtcgttcttgtgttaacagctgttcgtgaatggatgagcggctgtgaggagagggacaaaggggactccaagagaaagactctcataacttgggttagagtcctgctccccaacttaggagctgtgattttaagcaagtcacaagtcccctccaagcctctatatgcttcgtacaaataataaattttagaaaataataatggcttagtgttttataaggactaaacacagtcttgcaggtagatgtgcctggaacactgtccattgattccaatataagaaagcataaaactaatcatagctatcatttattgagcccttactctctgccaggcactgtgctaagtaatttacataggtgacctcatttgaccctcacaacccaaggaagagaatattttgtcaccattttataggtcattaagagattaagaaacttgcccaatattacacagatagttaagtttcaaagccagatctgaaacatcctggtctgactctagagaccatttaaccactaaaacgtccgcctctgctgtgttagtgatctctctgtgccccatggtgtctgacacattatagatgctccgtgtttctgaaatatgtctatttattaaaggctgagcatagcgcctggcccaggagcctaagaaacttgaccgagtcatgcaactattaagttttttttgtttttatttttgttttttcgagacagaatcttgctctgtcgcccaggctggagtgcagtagcgcgatctcagctcactgcaagctccgcctctcgggctcacgccattctcctgcctcagcctcccgagtagctgggactacaggcgcccgccaccacgcccggctaattttttgtattttttttagtagagatggggtttcaccgtgttagccaggatggtctcgatctcctgacctcgtgatctgcccacctcggcctcccaaagtgctgggattacaggcgtgagacaccgcgcccggcgccactattaagttttaggaccaggatttgaacacaaacactctggctctagagtctacgctttttaaccataattctgggctgaatgaataattgcaatccttctttgtcttcctctttgaataaaatgatttgtcattttattcatttatcctctttgtcacttaatattccatgtttcaagagtcaccaggacattctggtgtagcatgaaggtatgataacacaggagaaggaacaaggagaggtcaaggctaggaaaggacattggggccataccatgagctgctgctgggatgttttattaggattgtgacaaatgtatagataagtacagaagaatttaacaatcgtctctacttagattttcttttatgttccttaatagtactgtatagtttgtatcctataggtcctattcggaatgttgttacatttttctggacatttgatgggttttttggttgctataatgaatggaacttttccttctaccatattttctgactaataattatatccaggaaaatttttaatcttatgtattaataagtaccttattaaattgtatgtatatacactaatttagtttattgttttatacaaactataattacataacattctattctgtggatctgcaataatttattcaaccattctcaccagtgggtcttcacctgtttcctttttttatgggggcaggaaggcgacaaagttttgctctgttgcccaggctggagtgcagtggcgtgatcttggctcactgcaatctctgcctcccaggttcaagcaattatcctgcctcagcctcctgagtaggtgggatcacaggcacctgctacaacacccagctaatttttgcatttttagtagagccagggtttcaccatgtgggccaggctggtctcgaactcctgacctcaggtgatccgcacgcctcccaaagtgctgggattacaggtgtgagccaccacacctggccttcacctgtttctatttttttggtattataaaaaatgctgcagtgaatatccttgtacatctatactagcacactcatgcttttatttctgtaagctatagccaaagggacagggtatgtgcatttgaaatgttaatatataatgagtattcccccaaagctccgtaacaatgtatagttctacctagagtgaatgattgcacatatttcttcttacccttaccaaaatttgatttatcttttaaatttttgttcacttaacaggtggtaattctgaaattctgaactctgaatttttaatttgtacttccctgaatacttgtaaaactgaaaaactttttattgcatttcgtcttttgtgaactgcctattcagatactcttttattgtttctaataattctcaattaagtttcttgggttttctagatgtaagttatatcacatataaatagtaataaatttgccttaagatttccaatatttataccctttgctttattttcttgtctaaatataatggcaaacactttcagaacaatgtgaaataacagaaataataggaagcatctctgccttgctcctaatattaatagaaattatcccatattttaccattaaatatgatgctgcaattttatctgagatatacatttctccattatattgaatagtattcatccattaccattttacttaggattttagtgggaattaatgtaagatgttatcagaaggtaatattgactttcttttttatccagtagtatgttaattaatagatttcctaatattaaatcatccaagaatttctaaaaatgaaaccttattccatttgtcatggtgtattatatttttaatatcttgtatgattggttaatttgtgtgtgtgtgtaatttttgattttggttttcttgagacagggtctcactgtcaaccaggccagagtgcagtgaagatcatacctcactacatccgtgaactcccgggctcctcccacctaagtctcttgagtagctgggacttcaggtacgcaccaccacacgtggctaatttttgtattttttgtaaagacatggtctcactttgctgcccaggctggtctcaaactcctgggctcaagtgatcctcccacctcggcctcccaaaggcttgggattacaggcgtgagccaccgcaactgggcctttcaatttttaaaaatttaaatataatattataaaacagaatacagcagcacatgaaaagaataacatactaggccgggcgtggtggttcacgcctgtaatcccagcactttgggaggccaaggtgggtggatcacaaggttaggagttcaagatcaccctggccaagatggtgaaaccccgtctctactaaaaatacaaaaattagccgagcgcagtggcaggcgcctgtaatcccagatactcggcaggcgcctgtaatcccagatactcggcaggctgaggcaggagaatcgcttgaacccaggaggtggaagttgcagtaagccaagatcgtgccactgcactccagcctgggcgacagagtgagactctgtctcaaaagaaaataacaacatactatgaccaaatggcttcagtttttgtttgtttgtctgggactgcaaagatgtatcaattttaggaaatctattaatgtagatcgccatcttaatatatcttaaagaaaaataatatcattttagttgatatttaaaggcaattaataaaacattcacatccatccttgacattttaaaactcttaataaaatagaaataaatgtatattccttaacataataaaatacatctcattctcaaagctactataatacttaataaggaaacatttaagcatcccccattaaacttagaaaaaagacagagattcattattaccattattatttaatatttttctggagatattaaccaacacaattagaagaaagaaatcagagatataaaatagaaaaggaagtaattatcattatgtacacataatatgattgcataactggaaaatccaagagaatcaactgaaaaatgatagaattaagggaggggagctgggtatgaaattaatatctagtaaaacaaatagcctttcatatatgaacaataatgaaaaattaaaagatataatgaatgatataaagagactgaaaaaataagttaaaagatacaacgagtggaaacaacagatgctggagaagatgtggagaaataggaatgcttttacactgttgatgggagtgtaaattagttcaaccactgtggaagacagtgtggggattcctcaaggatctagaactagaaataccatttgacccagcaatctcattactgggcatatacccaaaggattataaatcattctacgataaagatgcacaagtatgtttattgtggtactattcacaatagcaaagcctgggaaccaacccaaatgtccatcaatgatagactggattaagaaaatgtggcacatatacaccatggaatactatgcagccataaaaaaggatgagttcatgtcctttgcagggacatagatgaagctggaaaccatcattctaagcaaactgtcacaaggacaggaaaccaaacactgcatgttctcgctcataagtaggagttgaacaatgagaacacatgaacccagggtggggaacatcacacaccgatgacgttccacgggtgggggcccgggggagggatagcattaggagaaatacctaatgtaaatgacaagttgatgggtgcagcaaaccaacatgaaacatgtacaactatgtaacaaacctgcacattgtgcacatgtaccctagaacttaaagtatattaaaaaaaagatataatgggtaaaagatgacattttcaatagtgaaaaaatatgaattactcaagaaacaaacttagctaagaaatggacgaggactttatgaagaaaacttctatacatacctgagacacacatatttgaaaaatgaatatcacattctcggatcaaaagaatcaatgtcacaacaaattcagttctccctaagttaaaatataaattgaacatatcccaattttaaaataccaataggactttttcttgatggtacacacagtaggaagggcaagactagacaagctgattataaaaatcagaaaaataaatttatagaaaaattcttgttttccccttttgaattttaaatgctgtgaatgtaattaccacttcaaaagttataaactacaaaaccttaaatatatttttaaaacacatacacacatagagaggattttttaaaataaaaatgtatttattttatatacataattgcaatttgccctttttgacctaatgctatatcatgaacatccctccaggcccatatttatagaagtatctcattcttttaataatatataatattttgtcacatagattaattgaaacttattaaaccattttccctattgatgaaattcaagtgtttgtttttcttcagtttgtttattttgaaacaggagtaatttttcttagccaggattagaagatgtaactataaaaagtaaaacaataaaaatattgaaagaaaattatagcctcaattggagggaaactttcctaaacaatgcaggaaacccagacaacttaaaggaaaagatagatatgttgtatttaattacatacaatgtaaactttccttgtgaaaaaaaagcctcataaaaaaagtgaagagacaaacaacaaattgggagaaagtatttgcctaaaaaaatggcagatgggttaatatctctaatacggagaaagtgcctaaaagttaagaaatgtgaagaatatgaacacacaattcacagacaagggaatactaatgaccaataagcatatgaaaagatcctcaacttcactaatcatggaaatgcaacataaagcaggtctaatttttcatccatcagattggcaaaaatgttaaagtacagataatacccagagctagcaagggcacgaggaaatgtacactatcaagcattcttggtgaacatctgattatcaacagcctttttggagagcaatctgattatagtagaaaaaaagttttaatcatcatattctttgacgcagcaatccaatttaacttaaaaaaatatatatgagaaaatagcctttagtgtctccctatgcccctccctccccggctcccagtgtatctcacttggtttaccgcctcacttcccagccagctggactctcatgcccaagccctcctctacctccatcatactctagccaatcaaagctagagcctgggatggggaaatggtcttggaaccctggaaggctttgtctagtgggtccccctgtgcttttaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggtgaggatagaccctagagcagagacggccatggggaggatcctgggcttgtgggaagggctggatcccgtgattttctctagtggggaaacaaaggactcttttttttttttttttttttttgagggagtctcgctctgtcacccaggctggagtgcagtggcgcgatctcggctcactgcaacctccgcctcccatgttcaagcaattctgctggctcagcttcccgagtagctgggactacaggcttatgccgccaccgccggctaatttttgtatttttagtagagacggggtttcaccatattggtcaggctggcctcgaactctgcctgacctcaggtgatcctcaggcgcccggctgactcactctccttgacattaaggaaagggtaaagaatatattgtctttttctttttcattagaactgatactattgcctctctatcagacactctgtctctgctatatgtttcaaagagcctggcaatctgcgcctcaacctaagattcctttaggctcttatatactataaatttatgaaatccaggtttgagatccagatactgcaatcttcattaacttcagcagctagtttaaccactctgtgcctcaatttgtgtatttataaaatgggaagagtaatacctgccctctatggctatactgaggatttgatatacagaaaagcactctaacagagaccctatagaagttccagctggaaagtagaaataaaatataaaccattttggagtgaatcaatggctgggattgcaggtctccctcagatatgggtcttggaagacccatatctcttactcttgtaggagaatggcattcaatatgcagggggcagcctccatctctgcctcttcaccgttttcatgagagtgaatttagtttactatgtataccaaggggagtcttaaaaggaaaagcaagtcatagcggatcaagctgccaagggagtgggggagggggctggcagcctcagcatctgccggatgagttttcagcagagagctggatttaaccgaggttggggttttgcgaggatccatcacagtaggagtaaagctaagggagctgagggtggatataagggagagattataataatggactacaaaatataaactacagaaggaagtgaagtttgaggagagtgaggggcagtacaaagttggcagggccaatgcattgcaaaattaggtcagagacacccatcgagccaaaacatcctgggttaacccaactattttctccacttctgtatccaggttacagattacttacagggaaaatcaagtgggcagactggcaccatcagagtcatggtctttggatatcaatggtccctcaataattagtctgtttctccagtccattctcactccatttccacacagtggctgtttttaatcatctctggtatttctgtggtctctctcatcctatatttcttagaaaaacttttactcatccttcaagtcagctccagcactaacttcactgtgaagtttccctgatgcttcagactcaggaatctctaagattcctcaattataataactgtggaattaaattgtaactttttgctaatttgtttttacattaggctttaaactctgagagtggccaggcacagtggttcatgcctgtaatcccagcagtttgggaggcagaggcaggagggttgcttgatgcctagagttcaagactagcctggacaacatagtgagaatctgtctctacaaaataaaaaattagccaggcatagtggtgcatacctgtagtgttagctattcggaaggcggaagcaggaggattgcttgagcccaggagttcaaaggtgcagtgagttacgattgtgccactgccctccagcctgggtgacacagcaagaccttgttttaaaaaaaaattttttaaattaaaaatccccggtcatctaatggttaggggaaaaaaaagttctgacagtagggctcacgtcctagtcctcatagccccagcagggcttggcagagtgaatacctaaacgtatttgttaagtggaggaacaaataaacctatgaattaatggatgctttgagcatattatttagtcccttaattttcattttccagatgaataaactactgcccaaggagttaggtaacttgcttacagtcacacagccatcgatagagctggaatttgtatttcctgtctgccagcactactgccaggttctgcttcagtccttccttgaagacttctagtgataaggagcagttacggtgaaattcacagaatgctacctgacctctgggtaattcttccctttccattccaggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacaggtgagtgctcaaatactcctaatgccaccaggtgggacagtgagcagggttgacagtggagatgtaaccagatagttcaggtcctggaaaggcagtttccttcttcctcaatccttttccaacatccccattggcagatgctgcctttcttcaaagcgcacacacaaacataatctcattttgtctttaattttagaactcttacttggggtggccattgcatttttactgacagggagatggtgacacaggggttgaagagacttgtccagtgctactcactggtgaaagtaaaaacagatagaaattaggcttcctggccaggcatggtggctcatgcctgtaatcccagcattttgggaggctgaggtaggcagatcacccgaggtcaggagttaaagatcagcctagccaacatggagaaaccctgtctctactaaaaatacaaaattagccgggtgtggtggcgcatgcctgtaatcccagctactcaggaggctaaggcaagagaatcgcttgaacctgggaggcggaggttgcagtgagccgagattgtgccattgcactctatcttgggcaactagagcgaaactgtgtctcaaaaaaataaaaaacaagaaaagaaaagaaagaaattaggcctcctgattcccaattcagaactctcccagaaatgtggctatatttctaaattcaggcagacaacgagattaggtttgagataatatgggtgtctgtcttaaggagcatttagttggaggaaacagaaaccaattcaaagtaccatagattaaaggaggaaaaaataaaaaagtacagctggccctcatgagttctagctcctggaatcagaaactagaaaggggacaggacgcaaaacagttaccgtttcaaactgtgaggcagcaaggcctctggcttctgcatctgtctttcactctatgcatgctccccctgctccattactactttggcatatcctaaatatggccactccagccccagctttaagtggcttccttaagtcaaattgtgcccaacagaaagtgtctctctgtgtaactatattcctagacaatagagcaagccttcaaaattctgtgggaaaaaaaaaatttacctagaattatatattcagccaaactataaaccaaatgtaaggaaagaaaaaagacactatcatgagatgcaatgactcaaaaaaatttgccttccatgtgatcttttcaaagaagctaccagaggatgtgcttcagtaaaacaagaaagtgaatccataaaggggataaaatgacatacaggaaacaaggagtctaacaaggaagttctaggctggacacagtggctcatgccagcacttttggaggccaaggtgggaggatcacttgagcccaggagttagagataagcctgggcaacacagggagacaccatctctagtggaaaagaaaaaaaaaaggaaattcaagaattaaaaaagggcagttagtccagaagagagcaagagaaagacgactctggaagggagatctctaggaggtaaaaatggaatcgacatatcatctttctaaaggcccattaaagacccaataaaaagattaaagaaatggatatggaaaactctgccagtaaaaaaataaaatcaggctctagaaaaaactaaattttacaaaagaaacatagcgcacaacttgattttgcaaaaaataacacagaatccaaattatgtaaacatgactaatttaaataaaatttgtggtacaattatttttagaagaatgcagagaaggaaaatgggtgaaagtataatcctcatctactatattctagcacatcttcatctactgtagcagaaagccaatagaaaatgtctaaattttatcactaggaagcagcaatatgagcatattatttaggaatataataagacatctcgaagagttgacagtggttgtctcagacaataagcctaggaggacaaaagggcactgctattattctctatgaacttttacaactatcttacttctccatgaacttacaactatcttacttttttttttctttttctttgattttttgagacagactctcactctgtggtccgggctggagagcagtggcgtgatctctgctcactgcaacctccacctccaaggttcaagtgattctcctgcctcagccgcccaaatagctgggactacaggcacacgccaccacccatccaactaattttttttgtatttttagttgagacggggttttgccatgacggccaggctggtctcaaactcctgacctcaggtgatctatccgcctcagcctagccaaagtgctgggattacaggtgtgagccaccgtgcctggcctatcttactttttaagaaaaacaagtataaattacccactcaccaccctccccccatgaaaaactggcccagagcctttgaacaaatgtttctaatcacctcctatggttcctagttaattcaaattttcaacttgtttagtttgactgactttgttccttgcttcctggtgtcttcctgtctgacctagctatagcattcagcacttctgactattccctccttcatcaaactgtcatctccagtggcttctgtgactgtactcccctggctgttctacccacctggctgttcttttgtcttctctatttcctcctcccacctctcaaacatgagtattccccaagactcacttctcaccccttcaaccttttctctttactctctctccctagttctcatctacccacgatttaaaccagcatctccctgcaactgaccagcaaatcaacttctccagcttgaacacctttcctaagttttaattaaacgtttaaactaaaaactgtactcctagctcctggatgtcccaccatttcctcaaactcagtatcaaagctatcctcctgagaccctatttctgttcatgacggagtcaactttggttcctccttttttcttaacccccaattcagagagttactaagtactgctgttcttccgcacagcagtacttagtggggaagaatagcagtactttgttattcctttccttccaaaggtgtttttcaggtcttcatcacctcacacttaacatattcctatagtctcctaactagtgagtcccttgagttcagcaactgtgccctagtcacctttgtatctcccacacctaccacagggcctagcactgagctgttgcctaatggtccagcaactctaaatactgtttctgcctccaatccattctacatactaccaccagcttgtctttccaaaatgctaatttgtacatgccacatcactcaaagttttaatggcttctcactgtctatggaataaagtctaaattacattagcctggcactagagactctatagcatttcattctatttatgtgaatacattgcttcagttaaactgcactagtggatactcctctttcattcatctaacaaatatgtattgtgcatcccaggcccagcgctatgccttggagaacagaatgaggtataacacagtccttgctccttataacctaaatcctgttctcctaatatattgttttagttgtgaagattctccctaaggaagaatgcttttctcatcttctcagcatatttaagtattagagtcagcacatctagatggttccccaagtgtggaaattaggtgcattttggaaggtaaaactagttaagaagagacaggtaataaacaatgtcagggtgggtggtggctcacgcctgtaatcccagcacttcaggaggctgaggctggcagatcatttgagatcaggagttcgagacaagcctggccaacatggtgaaaccctgtctctactaaaaatacaaaaaatagccgagtgtggtagcacgcacctgtaatcccagctacttgggaggctgaggcaggagaatcacttgaacccgggaagcagaggttgcagtgagccgagattgcgccactgcactcgagcctgggcgacagagccagactctgtctcaaaaaaagaaataataaaataaaataaaaaacaatgtctgccatttactgagtgcttactgtgggccaggcattgtgctaagtgatattatattatttaatctccatggtcttttgagctattgtcctgtgataactcaagcttgaagataatttatgttcatccaacagtaaatgatggataaaaatccagatctagtccaggtgcagtgtctcatgcctgtaaccccagcacttagggaggccaaggcaggtgcatcacttgaacccaggagttcgagaccagcctgggcaacacagtgaaaacctgtctctacaaaaaatacaaaaattggctgggcgtggtggcacatgcctgtagtcccagctactagggaagctgaggtgggaggatcgattgggctcggggcatgaggctgcagtgacccatgatcatgccactgtactctagcctggatgacagagcaagaccctgtctcaaaaaaacaaaaacaaaacaaacaaacaaacaaaaaaaacccagatctattccaaaagggcaagattttaacttatgctagattgcttgaaccactctagaaaatggggctatttggggatacccaagtccaaggcgactaagctgtttcagctatctctgtggcaaaactttagaattactttaagatctatctgcatccctagtgtctgacacacaggagattctatacttatttatggctgcctaagtacatcatcattacccacaatgttaaaaatacttatttgggcaacgaattacagagggaggaatccttggagatcataaaagagatgttatgagatgatgcaaaaggagatactgatgatttctgaaaccctcccctgatccatgattctcttttgaaccagagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactgatccaaaggcactaaggaggaagacagataaatcagacttttcaatgggtaggaggtaagactcattaggaatgaaggcctgtgagagaggcaagttagtacaactacctctactcactgcatgaacagagggctacaagttgaagcaacagattttcagctattagaggaagaaaaggcaagagacagacttggtttggagatgggttttgaacaatgcggctcctcagcaaaggctgatggccagattgagtatattaaacacatgtagctgagtcctctgaaaaccatttaccaatatagattagcgttttccctattagataacaaaaagtgaaacttccaataatttgtcataacgtttttgcataacaagcaactgattcaggtttttgcctggccttggcattcttaactccattttatttaggcattcctcaaatcaataactaccactgttttgaatggcatcagaatgtaagctctatatatatgtaaggactttgtcttctttaccccaacgaaaagtcccacacatatggcaggctcttaataaatttgttaaaaaacctgtatgatgaatcagatgctttacacatgatgattctaaccttatacaacccttgcaagcaaacatcccctggttactcatcaggaaacagacacaaggaagttaaatagggcctggtgcggtggctcacgcctgtaatcccagcactttgggaggccaaggcaggcagatcctttgagcctaggagtttgaggccagtctgggcaacatggcaaaaccccaactatacaaaaaaatacaaaaattaggcatggtggcacacaactgtagtcccaagctaaggcatgaggatcacctgagcccaggctggttgaggttgcagtgagccatgatcatgccactgtactccagcctgggtgacagggtgagacactttctcaaaggaaaaaaaaaaaaaaaaagagttaattgttgcccgtcacagcaattaatacagatccttctcactctaaaaccttacactcagtaatgatctactatatgcaaagcacctcttacatccttcaccaccccattcattctgagattgactcctcccctttccagaaacaggaccacctaaacattccctattccagtcccttatttgcaagtcatcaaaagaaaacagagatttcaaaaagaaaacagagaccttatctgtaatccttggtaaggatcttccaaatttaagcctatgccagttttcaggaggaaacatgaatatgaaacagtctgacctttagacataattttttgttgactttaaattcccttggttaggccactgtaaccagtaaaataaattttattttagaataaaaattataaaggggaaattgagtctagccatacaacctactactagttactatctttgattcccaagtcatcctagagcaaaaaaaaaaaaaaaaaaatcatctctggcctttttttccttttccactcaggtgaagagaatgagcttttgaatccaattttttgttttctcctatattcaattcaagtagctttaaagttaaccaaaggaaaaaaccaaagctcaatatttgattaaacgagaaaatatacactacttagaagctttcttttctttatccttcttccccaactcaaggcttagtagaattattgaaagaggtagtattcagtagaatagtacacatgctttttcaggtccagaaacaccacataggtcaagttatcatgcttacatgtggggaaaaggaggagggagtttcctggacctctgtgcctctctcagctcatgaactagtttcagtgaatatccttgtcttaccactgtgccaacaattcagagctatacgtggaaaacctaccttcaactttttgagtggcatctattgcttctttgattgttccttccagcaaggagcgatcaaaggctagcccccttcccactcccaccagaatcagatttgctcaagattacaaccctaatttagtaataagatgcaatacataaaatagttcccactttccttttccaatccctttacagtcatgagggcctatcacgcacgcatctcaggacaggtgagacttcattatatcaggtattttgttgctattctaagttataaggcagtaatacaaactttctttccacagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaag

SEQ ID NO: 362 - DNA, 4452 bp, Homo sapiens
  1st Promoter of CD160
gctcacgcctgtaatcccagcactttgggaggccaaggcaggcagatcacttgaggtcaggagtttgagaccagcctggccaacatgatgaaactgtctctactaaaaatacaagaattagtccagcatggtggcaggctctcgtaatcccagctactcagaaggttgaggcaggagcatcacttgagcccaggaggcagaggttacagtgagctgagatcacgccactgtactccagcctgtgtgacacagcgaaactccatctctaaataaataaataaataaataaataaataaataaataaataataaataaataaaaagttatccaggtgtggtggcgtacacctgtggtcctagctgcttgaggggctgaggtgggaagatcactcgaccccaggaggtcaaggttgcagtgagccatgattgccccactgcactccagccttggtgacagagcaagaccctgtctcaaaaaaaaaaaaaaaaaaaggaaagaaagaaaaaagaaaaagaaaaaaaatgggtgggtgggaagataaggtcagtcattcatcctccccccaccacatcaggaccattttggtgcccccactcgttgcctcccctgctcaccaccaccctcacccaagccttcttgacagctccctgaccttcttccctttcagcctggagcagctgtgttctctgtcctacttctaaccaaaacctactctcaggagaagacttggtacctttctttatacttgagaggacattctgtccttttatcttctagttattctatcatcagtcctttccttattatgaattagcaaatacaaaatctttgttccccagggtaaagaaaagaattttaagaagtggtttttcttagccccctcagcaccctagtctatttctaacaccaaaaagacaaaacaagggagaggaaaggagaaggagatggaggaccagttgcaggagagaaaggagaaaaaaatccacagtgggggtggcggaagatctatgacttctaacaacccattctgtggttttcaaagagcgaatataataacagctatgaaagtgtgagcaatgacgaaactggagagatagggttttaacaagatgcaaggacaatctgaggactgagagccatttcaacgtgagcccccagtctgagaacaagaaagaagaacttctgtctcgaggtaaaaaggcctgctggggacctggggtccaggtgaagggatgggatggttgacagaactgctcaggtgaggacaggcttctcatgaggtccctgagaaacttgccttttggagggaaatgtcctctgccctctggagcctggggagaaggttatttctgcccgccagaccagcatgctcgcttttcttccatgggcattcaggaatcctggccccattctgacattcctcaaatggaggaattcctcaaattaccagaggaaagttaccaaagtttagatctgctggagctcttcaaggattggcctgagacaagccgggaggtgccacggggcttggagctggccctgtgaggcacctccgggggaagttcatgtcctaggtggttcacgtcatggacctcttggaggtccgtgaatagatttattcatgggatttgtgaattggggggaaaaatacatctttattttcactaatctttaattgaaagtcagcacttgcttcagttatgaatgtagacaatgaaccacaatagaatttgccatcaatagaaaacacaaatattttcaaatctcattacagtttttatagatttctccaaatgtccttaacgctcagcactactacagaattacaacagttattaggctgatgtcaaatctaaagaagcatgtgtactgctctaccacacattcttctaatgttttgacaactgtcttgtcataatttgttccctttattatcccatgtatcttattaatttttaaatgttgttctgagaagggactccatatgccttcccagaccaccaaagaggtccatggcgcctttatgtcaggcacctgctttggtgtgttgagcaggaagcctgagatctcagacaagagcttcaagggccccccagcccaaacctctgtctactaacaagtctggttctactttaaggcagttggggttgtggagattgaaaaagaagccccttcacagctgcaaatgagatctttctgggcatctttttcagtgtcgtgggagatctgtatacagaggtatttgtggagctcagagctgaccttccagctcctctgagaggttagatccgggctccggtggcagaggaaatggagactcttccttgccctcttgtccccaccctccccagaaaacctctggcaaagctttatgtgtcatctaaccgtcaccacattcctatgaggtagttttaaacacaagaggaatgtgaggctgagtgaggtccagcaatgtgctggtcacacaaagcttggatttgaacccaggagtccacaagactccaggaccgcctccgaaggtgcgggagggaagagtttcccgccgtctgtgagctgtcgcctgagagaggcaccgagccctggggccaccagcgcagctcaggagccccggggaccatcaaagatgaggatgccaactccacgggcaccctcccccctgcccgcgctggggctcacaacgttttaagaggggagacccgcccctggcgtgtagtgggcccggaaaattcccagacttctcacgaccacccgctctcccctctgttgagggccaggtgccgctctagtacatgctgcgtccccaggacccaccaggcccaactttgcaccccctcatctcccctcctagtttagactttccctggctagcccccatgctcgctggatggcccatggctggagtgacgcgggccaacgcggggcaggtagggggtcactcggctttggctgaaaggcagcgccctctagcggccagagtgcgaaatcagcgccgccggctccgcgctgccccgcctgcatcacaacagggtgctcccctcccgggcaccaaggtcacttcccagagcatccttgcccagtgacctcgctgccccccagcgctggtgaggggcccacaacagacttacatgctcttcttcaactcggccctaggcaccgcgaagtctggccactccagcggagtgaccagctgcatcagcccctcccgcctgtcctctctctccttggaagcggtccctaccctgcgcccctcccatcccgctgcaccagtcccttaggaaacacgcctagagaagggacacgaccttgtcaacattccacagctacctagtgcggagccaggactggaagccagatctcctcagcccattccccaccttaattcacccaccgtattctttagtcaccagctcccgagagcccacaaacaactatgaaggcctaacttcattgccatcttgcagcctttccacatccctcatccagaatttctcctgtgctgccccttgacactttatgaccttattacttagtacagtcgttcttgtgttaacagctgttcgtgaatggatgagcggctgtgaggagagggacaaaggggactccaagagaaagactctcataacttgggttagagtcctgctccccaacttaggagctgtgattttaagcaagtcacaagtcccctccaagcctctatatgcttcgtacaaataataaattttagaaaataataatggcttagtgttttataaggactaaacacagtcttgcaggtagatgtgcctggaacactgtccattgattccaatataagaaagcataaaactaatcatagctatcatttattgagcccttactctctgccaggcactgtgctaagtaatttacataggtgacctcatttgaccctcacaacccaaggaagagaatattttgtcaccattttataggtcattaagagattaagaaacttgcccaatattacacagatagttaagtttcaaagccagatctgaaacatcctggtctgactctagagaccatttaaccactaaaacgtccgcctctgctgtgttagtgatctctctgtgccccatggtgtctgacacattatagatgctccgtgtttctgaaatatgtctatttattaaaggctgagcatagcgcctggcccaggagcctaagaaacttgaccgagtcatgcaactattaagttttttttgtttttatttttgttttttcgagacagaatcttgctctgtcgcccaggctggagtgcagtagcgcgatctcagctcactgcaagctccgcctctcgggctcacgccattctcctgcctcagcctcccgagtagctgggactacaggcgcccgccaccacgcccggctaattttttgtattttttttagtagagatggggtttcaccgtgttagccaggatggtctcgat

SEQ ID NO: 363 - DNA, 2052 bp, Homo sapiens
  1st CTCF Binding Site of CD160
taggctgatgtcaaatctaaagaagcatgtgtactgctctaccacacattcttctaatgttttgacaactgtcttgtcataatttgttccctttattatcccatgtatcttattaatttttaaatgttgttctgagaagggactccatatgccttcccagaccaccaaagaggtccatggcgcctttatgtcaggcacctgctttggtgtgttgagcaggaagcctgagatctcagacaagagcttcaagggccccccagcccaaacctctgtctactaacaagtctggttctactttaaggcagttggggttgtggagattgaaaaagaagccccttcacagctgcaaatgagatctttctgggcatctttttcagtgtcgtgggagatctgtatacagaggtatttgtggagctcagagctgaccttccagctcctctgagaggttagatccgggctccggtggcagaggaaatggagactcttccttgccctcttgtccccaccctccccagaaaacctctggcaaagctttatgtgtcatctaaccgtcaccacattcctatgaggtagttttaaacacaagaggaatgtgaggctgagtgaggtccagcaatgtgctggtcacacaaagcttggatttgaacccaggagtccacaagactccaggaccgcctccgaaggtgcgggagggaagagtttcccgccgtctgtgagctgtcgcctgagagaggcaccgagccctggggccaccagcgcagctcaggagccccggggaccatcaaagatgaggatgccaactccacgggcaccctcccccctgcccgcgctggggctcacaacgttttaagaggggagacccgcccctggcgtgtagtgggcccggaaaattcccagacttctcacgaccacccgctctcccctctgttgagggccaggtgccgctctagtacatgctgcgtccccaggacccaccaggcccaactttgcaccccctcatctcccctcctagtttagactttccctggctagcccccatgctcgctggatggcccatggctggagtgacgcgggccaacgcggggcaggtagggggtcactcggctttggctgaaaggcagcgccctctagcggccagagtgcgaaatcagcgccgccggctccgcgctgccccgcctgcatcacaacagggtgctcccctcccgggcaccaaggtcacttcccagagcatccttgcccagtgacctcgctgccccccagcgctggtgaggggcccacaacagacttacatgctcttcttcaactcggccctaggcaccgcgaagtctggccactccagcggagtgaccagctgcatcagcccctcccgcctgtcctctctctccttggaagcggtccctaccctgcgcccctcccatcccgctgcaccagtcccttaggaaacacgcctagagaagggacacgaccttgtcaacattccacagctacctagtgcggagccaggactggaagccagatctcctcagcccattccccaccttaattcacccaccgtattctttagtcaccagctcccgagagcccacaaacaactatgaaggcctaacttcattgccatcttgcagcctttccacatccctcatccagaatttctcctgtgctgccccttgacactttatgaccttattacttagtacagtcgttcttgtgttaacagctgttcgtgaatggatgagcggctgtgaggagagggacaaaggggactccaagagaaagactctcataacttgggttagagtcctgctccccaacttaggagctgtgattttaagcaagtcacaagtcccctccaagcctctatatgcttcgtacaaataataaattttagaaaataataatggcttagtgttttataaggactaaacacagtcttgcaggtagatgtgcctggaacactgtccattgattccaatataagaaagcataaaactaatcatagctatcatttattgagcccttactctctgccaggcactgtgctaagtaatttac

SEQ ID NO: 364 - DNA, 5596 bp, Homo sapiens
  2nd Promoter of CD160
acacaggagattctatacttatttatggctgcctaagtacatcatcattacccacaatgttaaaaatacttatttgggcaacgaattacagagggaggaatccttggagatcataaaagagatgttatgagatgatgcaaaaggagatactgatgatttctgaaaccctcccctgatccatgattctcttttgaaccagagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactgatccaaaggcactaaggaggaagacagataaatcagacttttcaatgggtaggaggtaagactcattaggaatgaaggcctgtgagagaggcaagttagtacaactacctctactcactgcatgaacagagggctacaagttgaagcaacagattttcagctattagaggaagaaaaggcaagagacagacttggtttggagatgggttttgaacaatgcggctcctcagcaaaggctgatggccagattgagtatattaaacacatgtagctgagtcctctgaaaaccatttaccaatatagattagcgttttccctattagataacaaaaagtgaaacttccaataatttgtcataacgtttttgcataacaagcaactgattcaggtttttgcctggccttggcattcttaactccattttatttaggcattcctcaaatcaataactaccactgttttgaatggcatcagaatgtaagctctatatatatgtaaggactttgtcttctttaccccaacgaaaagtcccacacatatggcaggctcttaataaatttgttaaaaaacctgtatgatgaatcagatgctttacacatgatgattctaaccttatacaacccttgcaagcaaacatcccctggttactcatcaggaaacagacacaaggaagttaaatagggcctggtgcggtggctcacgcctgtaatcccagcactttgggaggccaaggcaggcagatcctttgagcctaggagtttgaggccagtctgggcaacatggcaaaaccccaactatacaaaaaaatacaaaaattaggcatggtggcacacaactgtagtcccaagctaaggcatgaggatcacctgagcccaggctggttgaggttgcagtgagccatgatcatgccactgtactccagcctgggtgacagggtgagacactttctcaaaggaaaaaaaaaaaaaaaaagagttaattgttgcccgtcacagcaattaatacagatccttctcactctaaaaccttacactcagtaatgatctactatatgcaaagcacctcttacatccttcaccaccccattcattctgagattgactcctcccctttccagaaacaggaccacctaaacattccctattccagtcccttatttgcaagtcatcaaaagaaaacagagatttcaaaaagaaaacagagaccttatctgtaatccttggtaaggatcttccaaatttaagcctatgccagttttcaggaggaaacatgaatatgaaacagtctgacctttagacataattttttgttgactttaaattcccttggttaggccactgtaaccagtaaaataaattttattttagaataaaaattataaaggggaaattgagtctagccatacaacctactactagttactatctttgattcccaagtcatcctagagcaaaaaaaaaaaaaaaaaaatcatctctggcctttttttccttttccactcaggtgaagagaatgagcttttgaatccaattttttgttttctcctatattcaattcaagtagctttaaagttaaccaaaggaaaaaaccaaagctcaatatttgattaaacgagaaaatatacactacttagaagctttcttttctttatccttcttccccaactcaaggcttagtagaattattgaaagaggtagtattcagtagaatagtacacatgctttttcaggtccagaaacaccacataggtcaagttatcatgcttacatgtggggaaaaggaggagggagtttcctggacctctgtgcctctctcagctcatgaactagtttcagtgaatatccttgtcttaccactgtgccaacaattcagagctatacgtggaaaacctaccttcaactttttgagtggcatctattgcttctttgattgttccttccagcaaggagcgatcaaaggctagcccccttcccactcccaccagaatcagatttgctcaagattacaaccctaatttagtaataagatgcaatacataaaatagttcccactttccttttccaatccctttacagtcatgagggcctatcacgcacgcatctcaggacaggtgagacttcattatatcaggtattttgttgctattctaagttataaggcagtaatacaaactttctttccacagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaagagcacagaaatttagctacagctccatggtgagccattaaaaggaaagagacactttacctgtgctccttggcaaggacctgccaaatgtgggagctaaggtttgtgggaacggaaagagatatggctgaagtagatgagtaagactcttattagtgatagtcttgaacctcaaactaaggattttagactgtatcccatggagataaaaggactagccatggaggcaaaaagacctggattcaaattctggctctgcaacataccagctatttgtcattgggcaaatgaattttttttttttttttttgagacggagtctcactctgttgcccaggctggagtgcagtggcatgatctcagctcactgcaacctccacctcccgggttcaagcaattctcctgcctcagtctcccaagtagctgggattacaggcatgcaccaccatgcctggctaatttttgtgtttttggtagagacggggtttcaccatgttggccaggctggtctcaaactcctgacctcaagtgatccacccgcctcagcctcccaaagtgctgggattacaggcgtgagccacctcacccagtgcaaatgaggttttgagatgctatttctgtttacctatctgtaaaaagggatattgcctattgtatcttctctttccacagaattgttctgagaatcaaaatgagagtctggatttgggacctagagccatttgagttctgactccaaagtctccaaagctttctccactacatcacattcatcttaatctttctctacctgttttaaatagttagttctgtgtttctaactaaataataaactcacataggtagagatgtcttttgtttttactattcaaataatcttctggagctactcaacattatacaatcactggaagtctcagaagatatatccaactataggaaaagtttcagccattgtactatactaattatagtccacatataaaaatctgtgacacataatcacagaaaggaaacatcactgcccaagtttatgaagacatttaagagcatcagattactagctctgactcaaactaagcggaatatatacaaagcaatcccactttgtacataccaactgagtcttgcttctaaagagtttatttactctgcttatctcgagacttggttaaacagaaacttaaaatacttgtgtcttggctttcaaaatgtgttgatacaattgccttcaaataagcctacaaattttcatgcataataggtggttttctggacacgcatcttagccccaatctgtatgagtgattcacaaacacgggttttgaacctgtgaggccatgaggttatcagaaggaatctatataccataatcttcagcctgaataaatatctttcaaatatttgtatatatttcaattggatgtagattctggtgtgactaataaattaacttaaaagcattactgaaatcatagcagctttttgttatgtattctttaatcaaaaatactaataatatggctatcaagttgttggaagggaatctaataatttgggggtttttgttttgagacagggtctctctctgttgccctggagtgcagtggcacaatcttggctcactacaacctctgcctccttggttcaaacgattctccctcctcagcctcccaagtagctgggactacaggtgcatgccaccacacctggctaatttttgtatttttagtagacatggtgttttattgtgctgcccaggctggtctcaaactcctgacctcaagtgatctgcctgcctcagccttccaaaatgctgagattacaggcatgagccacaatgcccagccaagaatctaataatttttggatcttgaaaattgtatttcttattagaaaaagtaaagaatcacaggcttacatcctatgatcacagatctaagtgttctggttgaaagaggaagaagaggcaacatacaaactacacttctgtggacaccaagtgtagtgtggcaggaaaacataaagtttgcatgtataaaaccttaaaagttgaatgcctacaatgtacttgtctgtggcaggtatgagagatcgaaaccttac

SEQ ID NO: 365 - DNA, 7524 bp, Homo sapiens
  1st Enhancer of CD160
atagatatgttgtatttaattacatacaatgtaaactttccttgtgaaaaaaaagcctcataaaaaaagtgaagagacaaacaacaaattgggagaaagtatttgcctaaaaaaatggcagatgggttaatatctctaatacggagaaagtgcctaaaagttaagaaatgtgaagaatatgaacacacaattcacagacaagggaatactaatgaccaataagcatatgaaaagatcctcaacttcactaatcatggaaatgcaacataaagcaggtctaatttttcatccatcagattggcaaaaatgttaaagtacagataatacccagagctagcaagggcacgaggaaatgtacactatcaagcattcttggtgaacatctgattatcaacagcctttttggagagcaatctgattatagtagaaaaaaagttttaatcatcatattctttgacgcagcaatccaatttaacttaaaaaaatatatatgagaaaatagcctttagtgtctccctatgcccctccctccccggctcccagtgtatctcacttggtttaccgcctcacttcccagccagctggactctcatgcccaagccctcctctacctccatcatactctagccaatcaaagctagagcctgggatggggaaatggtcttggaaccctggaaggctttgtctagtgggtccccctgtgcttttaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggtgaggatagaccctagagcagagacggccatggggaggatcctgggcttgtgggaagggctggatcccgtgattttctctagtggggaaacaaaggactcttttttttttttttttttttttgagggagtctcgctctgtcacccaggctggagtgcagtggcgcgatctcggctcactgcaacctccgcctcccatgttcaagcaattctgctggctcagcttcccgagtagctgggactacaggcttatgccgccaccgccggctaatttttgtatttttagtagagacggggtttcaccatattggtcaggctggcctcgaactctgcctgacctcaggtgatcctcaggcgcccggctgactcactctccttgacattaaggaaagggtaaagaatatattgtctttttctttttcattagaactgatactattgcctctctatcagacactctgtctctgctatatgtttcaaagagcctggcaatctgcgcctcaacctaagattcctttaggctcttatatactataaatttatgaaatccaggtttgagatccagatactgcaatcttcattaacttcagcagctagtttaaccactctgtgcctcaatttgtgtatttataaaatgggaagagtaatacctgccctctatggctatactgaggatttgatatacagaaaagcactctaacagagaccctatagaagttccagctggaaagtagaaataaaatataaaccattttggagtgaatcaatggctgggattgcaggtctccctcagatatgggtcttggaagacccatatctcttactcttgtaggagaatggcattcaatatgcagggggcagcctccatctctgcctcttcaccgttttcatgagagtgaatttagtttactatgtataccaaggggagtcttaaaaggaaaagcaagtcatagcggatcaagctgccaagggagtgggggagggggctggcagcctcagcatctgccggatgagttttcagcagagagctggatttaaccgaggttggggttttgcgaggatccatcacagtaggagtaaagctaagggagctgagggtggatataagggagagattataataatggactacaaaatataaactacagaaggaagtgaagtttgaggagagtgaggggcagtacaaagttggcagggccaatgcattgcaaaattaggtcagagacacccatcgagccaaaacatcctgggttaacccaactattttctccacttctgtatccaggttacagattacttacagggaaaatcaagtgggcagactggcaccatcagagtcatggtctttggatatcaatggtccctcaataattagtctgtttctccagtccattctcactccatttccacacagtggctgtttttaatcatctctggtatttctgtggtctctctcatcctatatttcttagaaaaacttttactcatccttcaagtcagctccagcactaacttcactgtgaagtttccctgatgcttcagactcaggaatctctaagattcctcaattataataactgtggaattaaattgtaactttttgctaatttgtttttacattaggctttaaactctgagagtggccaggcacagtggttcatgcctgtaatcccagcagtttgggaggcagaggcaggagggttgcttgatgcctagagttcaagactagcctggacaacatagtgagaatctgtctctacaaaataaaaaattagccaggcatagtggtgcatacctgtagtgttagctattcggaaggcggaagcaggaggattgcttgagcccaggagttcaaaggtgcagtgagttacgattgtgccactgccctccagcctgggtgacacagcaagaccttgttttaaaaaaaaattttttaaattaaaaatccccggtcatctaatggttaggggaaaaaaaagttctgacagtagggctcacgtcctagtcctcatagccccagcagggcttggcagagtgaatacctaaacgtatttgttaagtggaggaacaaataaacctatgaattaatggatgctttgagcatattatttagtcccttaattttcattttccagatgaataaactactgcccaaggagttaggtaacttgcttacagtcacacagccatcgatagagctggaatttgtatttcctgtctgccagcactactgccaggttctgcttcagtccttccttgaagacttctagtgataaggagcagttacggtgaaattcacagaatgctacctgacctctgggtaattcttccctttccattccaggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacaggtgagtgctcaaatactcctaatgccaccaggtgggacagtgagcagggttgacagtggagatgtaaccagatagttcaggtcctggaaaggcagtttccttcttcctcaatccttttccaacatccccattggcagatgctgcctttcttcaaagcgcacacacaaacataatctcattttgtctttaattttagaactcttacttggggtggccattgcatttttactgacagggagatggtgacacaggggttgaagagacttgtccagtgctactcactggtgaaagtaaaaacagatagaaattaggcttcctggccaggcatggtggctcatgcctgtaatcccagcattttgggaggctgaggtaggcagatcacccgaggtcaggagttaaagatcagcctagccaacatggagaaaccctgtctctactaaaaatacaaaattagccgggtgtggtggcgcatgcctgtaatcccagctactcaggaggctaaggcaagagaatcgcttgaacctgggaggcggaggttgcagtgagccgagattgtgccattgcactctatcttgggcaactagagcgaaactgtgtctcaaaaaaataaaaaacaagaaaagaaaagaaagaaattaggcctcctgattcccaattcagaactctcccagaaatgtggctatatttctaaattcaggcagacaacgagattaggtttgagataatatgggtgtctgtcttaaggagcatttagttggaggaaacagaaaccaattcaaagtaccatagattaaaggaggaaaaaataaaaaagtacagctggccctcatgagttctagctcctggaatcagaaactagaaaggggacaggacgcaaaacagttaccgtttcaaactgtgaggcagcaaggcctctggcttctgcatctgtctttcactctatgcatgctccccctgctccattactactttggcatatcctaaatatggccactccagccccagctttaagtggcttccttaagtcaaattgtgcccaacagaaagtgtctctctgtgtaactatattcctagacaatagagcaagccttcaaaattctgtgggaaaaaaaaaatttacctagaattatatattcagccaaactataaaccaaatgtaaggaaagaaaaaagacactatcatgagatgcaatgactcaaaaaaatttgccttccatgtgatcttttcaaagaagctaccagaggatgtgcttcagtaaaacaagaaagtgaatccataaaggggataaaatgacatacaggaaacaaggagtctaacaaggaagttctaggctggacacagtggctcatgccagcacttttggaggccaaggtgggaggatcacttgagcccaggagttagagataagcctgggcaacacagggagacaccatctctagtggaaaagaaaaaaaaaaggaaattcaagaattaaaaaagggcagttagtccagaagagagcaagagaaagacgactctggaagggagatctctaggaggtaaaaatggaatcgacatatcatctttctaaaggcccattaaagacccaataaaaagattaaagaaatggatatggaaaactctgccagtaaaaaaataaaatcaggctctagaaaaaactaaattttacaaaagaaacatagcgcacaacttgattttgcaaaaaataacacagaatccaaattatgtaaacatgactaatttaaataaaatttgtggtacaattatttttagaagaatgcagagaaggaaaatgggtgaaagtataatcctcatctactatattctagcacatcttcatctactgtagcagaaagccaatagaaaatgtctaaattttatcactaggaagcagcaatatgagcatattatttaggaatataataagacatctcgaagagttgacagtggttgtctcagacaataagcctaggaggacaaaagggcactgctattattctctatgaacttttacaactatcttacttctccatgaacttacaactatcttacttttttttttctttttctttgattttttgagacagactctcactctgtggtccgggctggagagcagtggcgtgatctctgctcactgcaacctccacctccaaggttcaagtgattctcctgcctcagccgcccaaatagctgggactacaggcacacgccaccacccatccaactaattttttttgtatttttagttgagacggggttttgccatgacggccaggctggtctcaaactcctgacctcaggtgatctatccgcctcagcctagccaaagtgctgggattacaggtgtgagccaccgtgcctggcctatcttactttttaagaaaaacaagtataaattacccactcaccaccctccccccatgaaaaactggcccagagcctttgaacaaatgtttctaatcacctcctatggttcctagttaattcaaattttcaacttgtttagtttgactgactttgttccttgcttcctggtgtcttcctgtctgacctagctatagcattcagcacttctgactattccctccttcatcaaactgtcatctccagtggcttctgtgactgtactcccctggctgttctacccacctggctgttcttttgtcttctctatttcctcctcccacctctcaaacatgagtattccccaagactcacttctcaccccttcaaccttttctctttactctctctccctagttctcatctacccacgatttaaaccagcatctccctgcaactgaccagcaaatcaacttctccagcttgaacacctttcctaagttttaattaaacgtttaaactaaaaactgtactcctagctcctggatgtcccaccatttcctcaaactcagtatcaaagctatcctcctgagaccctatttctgttcatgacggagtcaactttggttcctccttttttcttaacccccaattcagagagttactaagtactgctgttcttccgcacagcagtacttagtggggaagaatagcagtactttgttattcctttccttccaaaggtgtttttcaggtcttcatcacctcacacttaacatattcctatagtctcctaactagtgagtcccttgagttcagcaactgtgccctagtcacctttgtatctcccacacctaccacagggcctagcactgagctgttgcctaatggtccagcaactctaaatactgtttctgcctccaatccattctacatactaccaccagcttgtctttccaaaatgctaatttgtacatgccacatcactcaaagttttaatggcttctcactgtctatggaataaagtctaaattacattagcctggcactagagactctatagcatttcattctatttatgtgaatacattgcttcagttaaactgcactagtggatactcctctttcattcatctaacaaatatgtattgtgcatcccaggcccagcgctatgccttggagaacagaatgaggtataacacagtccttgctccttataacctaaatcctgttctcctaatatattgttttagttgtgaagattctccctaaggaagaatgcttttctcatcttctcagcatatttaagtattagagtcagcacatctagatggttccccaagtgtggaaattaggtgcattttggaaggtaaaactagttaagaagagacaggtaataaacaatgtcagggtgggtggtggctcacgcctgtaatcccagcacttcaggaggctgaggctggcagatcatttgagatcaggagttcgagacaagcctggccaacatggtgaaaccctgtctctactaaaaatacaaaaaatagccgagtgtggtagcacgcacctgtaatcccagctacttgggaggctgaggcaggagaatcacttgaacccgggaagcagaggttgcagtgagccgagattgcgccact

SEQ ID NO: 366 - DNA, 11276 bp, Homo sapiens
  2st Enhancer of CD160
agccctcctggcctcctctatatctttcaaagcagaaggtagaatgggaaaatctggatttaggatcagaacacctgagttcatcgcaatcccagcaatttgtgaggccaaagcgggcagattgcctgagctcaagagttcgaaaccagcctgggccacatggcaaaaccttgtctctacaaaaggtacaaaaagccaggcatggtggtgcatgcctgtagtcccagctactctggaggctgaggtgggaggatcacttgattgagaggcagaggttgcagtgagccgtgatcatgccactgcactccagcctcaatgacagagcgagaccctgtctccaaaaaaaaaacaacaaaacaaaaaagaaagaaagaacacctgagttcaattctgacgccaccatttcccatttcccaggtgtttgatccagagtaattcatttttaactctctgggtctcaccttcatcatgtataaatagttgttattgtatggtttttagaaatttttaaaaattgctgttgttgttgttgttgtttgagatggagtctcactctgttacagcccaggctgaaatgcagtggtgcaatctcagctcactgcaacatccgcttcctgagttcaagtgattctcctgcctcagcctcccgagtggctgggattacaagtgcccgccaccatgcctggctaattttttgtattttcagtagagacagggtttcaccatgttggccaggctggtctcgaactcctgacctcaagtgatcctcccgccttggcctcccaaagtactgggattacaggcctggtgtattccttttgtctctggtttatttcattcaatatgatgtttgtgaggttcactcacgttgctgtgagtagctgtagttcattcattttcatactaggattccatttacatgatgtccaaatatagggcagaactttgggggattcctgcttaggtggtaacacacgaccctaacttctggtatgctggcaatattctagttcttgagctaagtgaaggttacacaggtgtttaagattaattaccgagctatgcatttttgtttcatgcacttattctgtataaataataattaaattatattgaaattttaaacattacaatatgtgtatagcatactggagtaagaagaagctcttccagtgacctgcctgaggatttcagctgtgctcagctctgcatgatctattcaaaaatgaaagggatcaatatcttggcatgccaataacctacatgtggcacacctgagcaatctggtcaggaagctttgatctctccaatttttaaaaattggctgggcacggtagctcatgcctataatctcagcactttgggaggttgaggcgggaggaatgcttgagtccaggagtttgagaccagcctgggcaacatggtgaaaccccatctctacagaaaatacaaaaattagctgggtgtggtggtgtgcacctgtagtcccagctactcaggagactgaggcaggaggattgattgagcctgtgaggtcaaggctgcagtgagtcacgatcatgccactgcacgccagcctgggctacagagcgagaccctgtctcaaaaaaaaaaaaaattaaattgtggtaaaatattcataacaaaaaaattatcattttaatcattttgattatacaattcagtggcattaagtactttcacactattgggcaaccatcaccaccatccatctccagaactttttcatcttcccaaagtgaaactgtgtagccgttaaacacgattttctattccttcctccccagcccctggcaactacctttctactttgtttctacaaatttgactactctaagcaccttctatgtgtggaatcatatgctatttgtccttttgtgactggcttatttcacttagcaaatgtcttcaaagttcattcatgttgtagcacatgtcagaatttccttccttttgaagggtgaataatattccactgtgtacatacatcacattttatttattcgtccatcaaggaatggattgctaccacctttaggctgcagtcaataatgctgccatgaaaatggatgtacaaatatttgttcaagtccctgttttcaaatcttttgggtatttgcccagaaaaggaattgctggatcatacatttaattttttaaggaaccaccatacaccatactgttttccacggtggctgcaccattttgctttctcaccagcaacatagaaaggttccaatttcaccacattcccatgaacacttgttcttttctgttttttgtttgtttgttttttaattgatggccattttaatgggtttgaggtgacatctcattgtggttttgatttgcatttccttaatgattcatgatgttgggcatcttttcacgtgcttactggccatttgtatcttctttagataaatgtctattcaatttgcttgcccatttttaaaatcaagttgtttttgttgttattgaattgtatcatctcaatttttctttattataaaacaaagactcagagaggtgaagtgacttagccaaagccccctcaggcagaaacatggctaaaaactctgtgcttttgcttttgtggccaatgccctttctactataccagtctgcctggctcagtgggtatcctcacatttttcctccaacttcaggtctgattgtcctagtatgcatgtcctactaccttgtctttttagtagctcattaacttactctgagcctggaattttaagctccagtggttttctctccctgtctagagtcaatatttatgacagtctccctttccactctctctgttactctggcctcatcccaccttaagaggcgactgtgtactctgcatacctttggaggaatttattaggccagagtccagatgcaagactgagataaatgttctatagcagtgtgggtgacaggctggagacggggcaatgccacttggctgcagcacacactgtggccccacatgactgctgactggaactttctagttcttttcagtaaccaagtgtcaggacaggggaggcctgaggatccttggagagctatgaattattaacacttgcaagctggctgccaaggatatccgagtagtaattcactcgttcttccttttcccagatgaggggtcagaatacacaatccttttccaccataagaaaaaggcacagaacaagaacatgccatgttctgggttcctgcatgtaccaaggtctggtcttggcactcttggagtgttggttaaaagggtatttggttgcccctttctgagagatacagaaacaatcagtggttcttgggcagtttggattctgccttaaaaagccagaccctcaagggcccccaaaggtccagaatggggaacaggagaagagcaaggaaagtgtcaggtatatcaaggctacagcctcagcctgacctcatccctctggggaccatcccatgcagaggtaaagggtcagtgagaaagaatcaggaaccatgaacagcctagtggcccaagtctgtagcttgatttaaaagacatccctcggccgggcacggtggctcacgcctgtaatcccagcactttgggaggccgtggtgggcggatcacctgaggtcgggagttcaagatcagcctggccaacatggaaaaaccctgtctctactaaaaatacaaaattagccaggcatgatggtgcatgcctgtaatcccaactactagggaggctgaggcagaagaatcgcttgaacctgggaggcagaggttgctgtgagctgagattgcgccactgcattccagcctgggcgacagagcaagactctgtctcaaaaaaagaaaagacatccctgccaggcgcggtggctcatgtctataatcccagcactttgggaggccaaggtgggtagatcacctgaggtcaggagatcgagactaacctggccaaaatggcaaaacgctgtctctgctaaagatacaaaaaaaaaaaaaaaaaaaatcttccgggcgtggtggcaggtgcctgtaatcccagctacttgggaggctgaggcagaagaattgcttgaacccgggaggtggaggttgcaataagctgagatcatgccattgcactccagcctgggcaagagaacgagactctgtctcagaaaaaaaaaagacattccacctcaaagtattaccttccccagaatggttccagtgccccctgacattctagcttggaaagtaaactaattgtgcccatcctgtttactctgttgcttagaattcttgccaggatgctgggcgcggtggctcacacctgtaatccctgcactgtgggaggccgaggcaggtggatcacttgaggtcaggagttcgagaccagcctggctaacatggtgaaaccccgtctctactaaaaatacaaaaaatgggctgggcgtggtggtgggcacctgtagtcccagctacttgggaggctgaggcaggagaatcacttgaacccaggaggcagaggttgcaataagccgaggttgcgccactgcactccagcctgggcaacagagtgaaagagcgaaactctgtttcaaaaaaaaaaaaaaaaaagagaaagaattcttgccaaggaaaaagcaatgcttgtcttttttttttttttttggaaatgtagtctcgttctgtcacccaggctggagtgcagtggcatgatctcagctcactgcaacctctgcctcctgggttcaagtgatcctcctgcctcagcctcccaaccaggattccaagtgtgctctaccacgcctagctaatttttgtatttttagtagcgacagggtttcactatgttggccaggctgaatttgaactcctgacctcaagtgatccacccacctcaacctcccagagtactgggattgcaggcatgagccaccacacctgaccaatgattgtctttattatccactgaagaaagtacattttctcctctaaagcccaagtcagcatgaggatggcaccatccagtttgccttagggtagagtgcagcctctgtgcctccagacaactgtagaagtgcctgcaattccactcagcagagtatttttttgctaagcaccctttgctaagtactacctattcatttcctctggatcaattgaaaataccagggagggtaaatgttaaatctttgatggaagaatgaggcatcaagacctgggactcttcgtgcctgagggaaggttgagaaagaatggccattgccaagtgtgggagaccagtttccccaacttcttcagccaaagacagcttcgcaggtgcctttcagaggagccctgcactgggattcacatagtgtggcttgcaggcagctctcggagcagccccacaggcctggtctcccttaggaggaggcctggccgcaaaggaacttggtgtcctctatgaccggagagggacaagacaggctctataggacaccaaagtaatttgggcacatttttctatgccttctgttttaaaagacataacttgagagtacctggtgagccattcactacagactggaaattagaatagaggctgagagagacatttttttccaggcctgccctgtcatcttgatacccaaacccctgaagctgccacctctgtctccacaataaaacagccctgaggtcaggtgtggtggctcgtgcctgtaatcctagcactttgggaggccgaggcaggtggattacctgaggtcaggagtttaagacaagactggctaacatggcaaaaccccgtctctgctaaaaatacaaaaattagccaggcatggtggcacgcgcctgttgtcccagctactcaggaggcagaggcaggagaatcgcttgaacccgggaggcagaggttgcagtgagctgagattgtgccactgcactccagcctgggtgacaaagcgagactctgtctcaaaaaaaaaaaaaaaaaaagcaaaaccaaaaaaacccagccctgactccctctccatattttatcattattctattaccaacgaccctgggctaaaggccagcagtgacagtggctgggacaggggctgagatgcctgcacagctttgctgtatgtgcctctggctctgaggcttggtttccttccagaaaactgttggctgtgctaggtgtcagttcacccttctccaggggagaagctgggcctcgcaccagcccctggagcctcaaatgtgctccctcacagccactggggctgctcaccaaccatcacagtaggccctgaactgggccaaggtcagagttactctccctcacccacactccccaaactcacacatgctaagcaacaaggggaaatgtgacaggagaatgagctctactctttacatgcgggtgtagcctctggcaccttcgtggcctggaagtctaacacagtccagtgaaatgtagaaatagctacaaagctaaagtgacctttggctgcagtgaacacacgagacttggactaagccgaggcaggtagcaggtctgagccatgtatctaacaagggagactgacaaactggactctgttcagagaagaggagaaaggacaaacaaaatattggaaccgtgaaagcactaaaataattgtaagaaataattgcaggagctggggatatttagcccagaaaggagaaactttagaatgattaactttcttcagagagttgatagactcctgagtagaaaggaaaactaggtaatgctggccaggcgcggtggctcacgcctgtaatcccagcactttgggaggccgaggcaggtggatcgcctaaagtcaggagtttgagaccagcctgaccaacatggtgaaaccccttctctactaaaaaatacaaaaaattagctgggcgtgggagcggtggctgcaatcccagctgctcaggaggctgaggcacaagaatcacttgaacccaggagacagaggttgcagtgagccaagattgtgccactgcactccagcctgagcaacagagtgggactctgtctcaaaaaaaaaaaaaaaagaaaaaagaaaaagaaaaagaacactaggtaatgatactagcccacacctgagtacttttatatgccaagcaccatgccaattgttttacacactttctcatttactctaaacagcagttctgtgatataactgcaattattatccccattccacagttgaggaaaacacagaaaggttgaatgacttatccaaggtcacgtagtaagtggagtcaggacgtaaatccaggcagtctgcctcatgtgcctgagacttgcctgccatccatagacatttcccatgtggggccctcagcagacttcattgaaagttaaaggcaggcaggactgacagcagcacaaggaagaattttactggaagtattccacaagggatattgtgtggatactttgggtggtagtgagctgcagaacagtagacagattcaagcagaggatgcaagaggtattaccctgaacagttcgcaaggagcattacagcaacaatagcaccagggaacttgttaggaatacaacttcttggaccacccccacccctgccctgagtccctgaattagaaactctgcagctgggcccagccatccgaattgttcaaagatgccctgctggtgatgttaatacacgctcaagtttgggaaacactggcatgcaagtgtctgcacacttccagggactggaagactgctgcagtctcttctgcttccaaaaccccataattctacagaagtaagatggaaatacaattcaatgtccactcagtttttctttgtcttaatgtcgagcacttactattagtatcttgaaaacaatctatcagttgctaaattgtgtaactggactcatacaccttagacattgaaaggcccacaggatacatatttgggaggctgtggatgaccaggaggcagcctatatttcagccacctcattgcttcactgacttccaaaccagccccatatgtccctgctccttgctggttcatactgttcctctacccctgccttttgaaatcctgccttctttcaaagctcaatttaaatgtcacattgtccacacagagtgcctaacactgtctgcgcccacagggcagtctccttttcttcctcccaacctcccctgcttcctgggttctctctcacttctggggtacttagagctcttggtgcattctgcttctgcttcatctcacgggaatgcaggcctctctcagcagtgtgctcgccttgacagcaggccccattcagtcatcgtcaaccccgcagggcctggcacacaataaccttgtgagaagcgaccaaaagcaacatttgcagaaaactgtgcatgcaaccgtttgcaggatggacagacactacatggctggtgaaaaggaagcgcgctgcgattcacttttgagccctgaggtctttgcagaactttgaggttttttgcaataaccagtatgaatacatgtgtgtcagctagtacttaagtggccccaacctcactcacccacaactctggttgcctttaacttctcttcatgttgctaataatcactgttttacagctcctggatgataaggaatgctgagtgctctcagagccaacctttgaaaggttctcatagacccaaggagggagaagtctccattttagagagcagagaggtcatctgtttgaacactatcatagagacagcaaataaggatactgggagagcagagaccaggcccagtttagcagtttatgccagtgggacccagtatcctgtgggctgtggtggactggtcctgtgaccaggatgatggtgagacactcctcttcccaacatgggttcccaacccccaggctcccagaatggactcattctgcagtgaaagctaacactttgatggagtgaagaagtatttcttttcttttttcttttttttttttttttagagacacagtctcactctggcatccaggctggagtgcagtggcgcaatcacggttcactgcaagctccgcctcccggggggtcacaccattctcctgcctcagcctccccagtagctgggactacaggcacccaccaccaggcccaactaatttttgtatttttagtagagacaggtttcactgtgttagccaggatggtctcaatctcctgacctcgtgatccacctgcctcggcctcccaaagtgctgggattacaggtgtgagccactgcgcctggcttggagtgaagaaatatttctaatatctgtctcatttgacgatggcttcagtggagccatctgggagttctcaaaccccagagcaccctactgtttttaggaccacagagtactacaataacaggaataagaaggaaaagagagtctctagactagttatgaaaaattttcccccaccctccctccacccttgaattcctgggtagcctggcactgggtggcaatcatgacaggtgttcctccagaaccgtggggcttcctggtgtgctgtgccctttggcacagggcctggcccagccttgcaggacttagagcccaatgcttctaattctcagactaatgttcctgccatctaagggcacaaccctagaatttaggaacaattgtaatctcccaagccatcactgaccaaggaagaacagaacagaatagaaatggatgggaagctgggagtggtggttcaggcctgtaatcccagcactttgggaggccaaggccagaggattgtttgagcccaggagttcaagagcaggcggggcagcatagggagacctcatccatacaaatcatttttaaaattatcaaccgagcgtggtggctcacgcctgtaatcccagcactttgggaggccaaggcaggcagatcacttgaggtcaggagtttgagaccagcctggccaacatgatgaaactgtctctactaaaaatacaagaattagtccagcatggtggcaggctctcgtaatcccagctactcagaaggttgaggcaggagcatcacttgagcccaggaggcagaggttacagtgagctgagatcacgccactgtactccagcctgtgtgacacagcgaaactccatctctaaataaataaataaataaataaataaataaataaataaataataaataaataaaaagttatccaggtgtggtggcgtacacctgtggtcctagctgcttgaggggctgaggtgggaagatcactcgaccccaggaggtcaaggttgcagtgagccatgattgccccactgcactccagccttggtgacagagcaagaccctgtctcaaaaaaaaaaaaaaaaaaaggaaagaaagaaaaaagaaaaagaaaaaaaatgggtgggtgggaagataaggtcagtcattcatcctccccccaccacatcaggaccattttggtgcccccactcgttgcctcccctgctcaccaccaccctcacccaagccttcttgacagctccctgaccttcttccctttcagcctggagcagctgtgttctctgtcctacttctaaccaaaacctactctcaggagaagacttggtacctttctttatacttgagaggacattctgtccttttatcttctagttattctatcatcagtcctttccttattatgaattagcaaatacaaaatctttgttccccagggtaaagaaaagaattttaagaagtggtttttcttagccccctcagcaccctagtctatttctaacaccaaaaagacaaaacaagggagaggaaaggagaaggagatggaggaccagttgcaggagagaaaggagaaaaaaatccacagtgggggtggcggaagatctatgacttctaacaacccattctgtggttttcaaagagcgaatataataacagctatgaaagtgtgagcaatgacgaaactggagagatagggttttaacaagatgcaaggacaatctgaggactgagagccatttcaacgtgagcccccagtctgagaacaagaaagaagaacttctgtctcgaggtaaaaaggcctgctggggacctggggtccaggtgaagggatgggatggttgacagaactgctcaggtgaggacaggcttctcatgaggtccctgagaaacttgccttttggagggaaatgtcctctgccctctggagcctggggagaaggttatttctgcccgccagaccagcatgctcgcttttcttccatgggcattcaggaatcctggccccattctgacatt

SEQ ID NO: 367 - DNA, 77 bp, Homo sapiens
  Sequence Region PDCD1 Amplicon
ccgaagcgaggctagaaaccgcctgacagctggcgcggctgcctggctccgagagacactcggcccggctctgaagg

SEQ ID NO: 368 - DNA, 77 bp, Artificial Sequence
  Description of Artificial Sequence: Synthetic oligonucleotide
tcgaagcgaggttagaaatcgtttgatagttggcgcggttgtttggtttcgagagatattcggttcggttttgaagg

SEQ ID NO: 369 - DNA, 50 bp, Homo sapiens
  Sequence of Binding Site of Probe cg27051683 of the Infinium HumanMethylation450 BeadChip
cggctgcctggctccgagagacactcggcccggctctgaagggaaaacat

SEQ ID NO: 370 - DNA, 16729 bp, Homo sapiens
  regulatory region upstream from CD274 promoter
ggaagtgaggagtgcctctgcccggccgccaccccgtctaggaagtgaggagcatctctgcctggccgcccatcgtctgggatgtgaggagcccctctgcctggccaccccgtctaggaagtaaggagtgtctctgcctgaccgcccgttgtctgggatgtgaggagcatctcttcctgaccgcccatcgtctggggtgtgaggagcatctctgcctgaccgtccaccgtctgggatgtgaggagcgcctctgcctggctgccccatctgggaagtgaggagtgcctctgcccggccgccaccccgtctaggaagcaaggagcgactctgcctgaccacccatcgtctgggatgtgaggagcgcctttgcccggccgccccgtctgggatgtgaggagtgcctctgcccggctgccccgtctgggaagtgaggagcgtctctgcctgagcgcccatcgtctgggatgtgaggagcgccttggcccggccgccccgtctgggatgtgaggagtgcctctgcccggctgccccgtctgggaagtgaggagcgtctctgcctgagcacccatcgtctgggatgtgaggagcgcctttgcccggctgccccgtctgggatgtgaggagtgcctctgcctggctgccccgtctgggaagtgaggagcgtctctgcctgagcgcccatcatctgggatgtgaggagcgcctttgcccggccgccccgtctgggatgtgaggagcgcctctgcccggctgccccatctgggaattgaggagcacctctgcccggccgccccgtctgggaggaagtgaggagcgcctctgcccggctgccccgtctgggaggaagtgaggagcgcctctgccccgttgccccaaatgggaagtgaggagcgcctctgcccggccgccccatctgggaagtgaggagtgcctctgcccggctgccaccctgtctgggaggtcaggggcgtctctgccccgccgccaccccgtctgggaagtgaggagcgcctctgcccggccgccaccccgtctgggaggtgaggggtgtctctgcccagccatcccgcctgggaagtgaggggcgcctctgcccggccgcccttcgtctgggaggtggggagcgcctctgcccggccgccccgtctgggaagtgggcgcctctgcctggccaccccgtctgggaggtgaggagcacctctgcccggccgccccatttgggaggtgaggggcgtctctgcctggccgccaccccgtctgggaagtgaggagcacctctgcccggccgccgccccgtctgggaggtgaggggtgtctctgcccggctgccccgcctgggaagtgaggggcacctctgcccggctgctctttgtctgggaggtggggagcgcctctgcccagccgccccgtctgggaagtgggcgcctctgcctggccgccccctctgggaggtggggagcgcctctgcctggccacccatcatctgggatgtgaggagcaccgctgcccggccgccaccccgtctgggaagtgaggtgtgcctctgcctggccgctccgtctgggaagtgaggagcgcctctgcccggccgccctgtctgggaagtgaggtgtgcctctgcctggccgccccatctgggaagtgtacccaacagctccgaagagacagcgaccatcgagaacgggccatgatgacgatggcggttttgtcgaaaagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccctgctctctgaaacatgtgctgtgtcaactcagggttaaatggattaagggtggtgcaagatgtgctttgttaaacagatgcttgaagacagcatgctcgttaagagtcaccaccactccctaatctcaagtacccagggacacaaacagggccaaaggccgcagggacctctgcctaggaaaaccagagacctttgttcttgtgtttatctgctgaccttctctccactattatcctatgaccctgccacatccccctctctaagaaacacccaagaatgatcaataaatactaaaaaaaaaaaaaaaaagaagaagattgagctgtctcaaggtcagtagaccagttattcttcctgtcatcccaccacaatccctgtccctctcctacatgccccttatttccatccacccactgctaactgccttagccatcctcctccagcttcactctcattctctccaagatagcatgtactaaagttctcaaaaatggaaaaacatacagatacttgaatgtcctggaaaatgtactttttagatgaatgcacagtagtgtctatcttatgtaagtttttaagtgggctgtcaactctacaagggacagaactccaatttttattcttaatccaactgggtgggtacagaagaccttgagttagttggttgcatttcagaatactgcaaaactcaggggaaagttacaactgctctacccttctcaacaatgttgctgataccttttctctttaataggctgttgagtagggttgtgaacctcaggtaagaatggccagtcttaattcattacagccaggattcccaagtattctgtgggaagcccagctaatggggttccaggtgagtgggagctgcaagcaagacttcagtgacttccttgtattctgatcaaggatacacctggagtttcagggctctgtgccagagtcagcttcaaagctgagcacaggataccaaaccacttaccaggatgaagaggcacaatgctgaaaaggcctgaggtggtgagatttccctccccttctgccactgtgccactcgagcaccctgtgaccagagttagaggccactcactgacagcagggtgatttggcagttctttcctttctccaaaccctaacagtcccatgcgactcatctctaacagcagaccagaacctgcctgaggttaggagcgagatattatccatcttgatagtctccatggtgtctacttcccctaaatatttgcacaaagcatgagagatacaagaaaaactgtggctcaggccacttgccattacttatttttcttctgaacataggagtggatgactaaatttttacacctgctgcaaacatttataaagaaaacaactgtactctagtactattcctccacataccctgtatatcacagagctgtgtgctttcaagtgctcctgtttgtaaggggttaggatctcccctgaaaagagagagtcctcatgtcaatcatctgggaaagaaacactgtctgggaagttagtatttagatttacctctttctgggccttgctctcctgggtctggacttgtagtctgaatgtgttagaggacgctcccaggtggaagggttaaaggtggaagccaagcaggaagaagagcttccttatgggaaaccacacctgagaataaataaatgcatcacaccttgtaaatttcaccctggagttcagtattttcaacattctttcctttcccaacttccccattcctggcaaagtcatttcccaaagtctgggaatattccgtagggtgtccagaacactttcagctatctcctcttgctcacaaaatatgtatcagaaaataagcaaaattgaccttgcaatagggataactttgatttcactcacttgtataagttaagtcttttaaaaattctaacacttttcaccaggggtaaaaaaaaatgtcttgctacttatacaattttaaacatcactgtgtctcagagtgatgttttgcagagaatgctgatttcaatccctctgtcttcattttccctttgattccttctgagatcttggaaggggtctttaatgcttcagccctgcctcaggtgagctatagattactatgggaaggtgtatttctggggaggagaagtggtgcctgcaagttccagacaacctttcttccggtcacccgtgagtacctagatttgattttacttggggggacataaaaaattaattgcatgaattctgtcatcgggattaccacgctgacttatttcccgatcagatgacacattgcctgaatgtatgactgatcgtctcaccacagtcattttcaatatttgcatcccattgaaattaagccacatccccttgcaaattccagcccagagcccacagcttccggaggttttctgtaattaacaccgcccttgctccctgaggccagttactgtaatttaggtattccccgcaatagtgtgctgatttctgttgagagcactgtgcctgtttttctcaactctattttaaagctacggagagatccggagtccacgccaggcgacaagaacgcgctctaatggaacgaagttggcaatacctatcagcaccaggggcagtgcgagagccaagagccggcgctcacgaggagcgggcgcccagcgctgcctggcaagcccggagcccaggagatcgcgctgactgacatggccgggctgacccttctccccacccgcctgcggccggtgttcactcactgggcggcgctggtgccgggaccaggcgaccggtacgcaaacctccaggcccgggctcctttcgcccgctgcagggaccgggcctcgctccgcccagcgtcgggattggcgcccagacacagtagatgacgcacctcagccaattcgcgcagccctcagcttctttaaagagccggcacttccgccagaagccgggtgtgtccttccgggccaggctcagtgttaccagaggtgggaggggaaggtcaaaagaggcaaattcaaagccgcggcgactcagctgccagatttttgagatgaggcagaggaagcggagtggaattctcaattaaaggcctctgtcccctcatctgttaaattggcactattaaaaagtcataaagataagacagaaacgagaaagaagagaattgactgaaattacccattcttttttgaacagagccgtctttctcccctgctgctcagagagatgtcggtctcgcctcaacctcaccagcaatttctatcttgaataagccacgtctctctcccagcctgagagaatgcttgaattgttggcactctgttctttgctaccaaatggcttggaaaaatagcatgaacgtcaccagtctctggccttcaggaaagtccctgctaaccaccacagcggtggagaaggcgtctaactttctccaggctcagcgtgtgagtgcacaccgccctgacctcctgggcgcgtcttgatgctctcaacagcagccctcaggattctggactgtgggtcccacattccagataccatttgtggaatggctggatgagaaaattgcaacagcaccctcatttccagttaagggaatgggcgggttaccaggaggtttgacactcttgaagggaggttaacaactgatgcaagaagtaaggaatcgtgtttgagtgcacagactctagcataaacacacctaccttcaatttctagctctgtcactgtcactctgaatttatcacctctgcaacaggactaaagccatctaatttattggattgtgaggactaaaagataatatatgtgggcatttagcacagtgtcgggcacatagttcgccttccgtaaccagtagtaaccagtaacagcggggagctgttagtaactatagggctgaggggtgggggaaggaagcagttactaaaaccaggcgagagcgagagcggtagctgtggctgtacgagagagtaaccaactggaaccgtgtcgttcagtagaggaaagcaagcaatgccaacttttcaccaagtaaggtgagattctatagttgtagccagtgctgagacgtcagcccaaagcagggacagagtggagaagacccacctctctgttctcccagctctgatatccagctggggtcttccgctggctggatccaccaggaagccagaagacagtggagctaggtctgtgtagtctgtagaggtcagcctactaggcacaatgcctggagggagaaatagaaaatatccagcacaccatttcttttttttgtttgtttttacactttaagctctagggtacatgtgcacaacgtgcaggtttgttacctatgtatacatgtgccgtgttggtgtgttgcacccattaagttgtcatttacattaggtgtatctcctaatgctatccctcccccctccccccaccccacaacaggccccggtgtgtgatgtcccccttcctgtgtccaagtgttctcattgttcaattcccacctatgagtgagaacatgcggtgtttggttttttgtccttgcgatagtttgctgagaatgatggtttccagcttcatccacgtccctacaaaggacatgaactcatcattttttatggctgcatagtattccagcacaccatttctacaaccttgggtttattgtgtttggaagcctagatccaaaggaaggaatgctgccactagaagaccccgtcactgaattgaattgaatttcaattcattgattcgaaagctgaaactgccctctggtcactttgattcctcacagtgacagaatggtatgattcatcccaaataccaaaaggaaattgggttacatctatatattgagggcaagaagaactatgcatgacacctggagattcactgggcacttcttaatactgccgtgtgccataataatgattatcagataactgaagtaatgcagaaatttcagatcatgaagaaattaaagtgttgaagcataccagataaaaaaatcctgatctacctaggtgttggcatagggcaggggaaacatacataagtaaatgagtaggaagctatgattattaattttagccttgcaacaagctctagaggcaggaattatagtagctctccatttaaaatgttaattacttcttccctgactctcttttcctattaccctgcataaagagtagtggtggagataaatattacaatttagtttctgggtgagaatgtgcctgaactgacatcccctcaaggcaatatggcagctgatgaggcttgttaaggaaaatcaaagctggacaatagctgtagcagtaaaaatagatttttattcagcaacttttgaaatagggggaaagagaccttggtaaagaactgggctcaattctgaatacagtaaggataagtggggatttatagccgaggagcaggttgtgtggatgggggtggggtccgtggatggaaaattactaagaagagacagcaagggtaggggaaatccttgctaaactgacctaacaggattcttgctaaaggtaggccagggtaagcagacatcacctgggggctggtgggggtaaggaatttgatcagatattgagagtggtcaaacattcagggtgggaagatcctctctaaactgacttagcaggattcttgccaacactgattctgcaaggatgaacactgcagcccaaggtcaatatctaatcaaggagatggcttagaggagcctgactaaagtttggtcgaggagaaatcttgtcagactctgtcattctcatatgtaagggatgagctgctcttcatctgagcaaaggaaaagaataaattctgggtgacaaaacaattagactgtctaggttttctgtttgccttccatcatattcattctcctcacttccctgccctgttctataccccaaagctgacctctttggacggcaccacctgggctctcctcagctggtttccatttgagtttggacagcgggaggcattcagggagatgggaggcaggaggaaaaagacatcagggtatattttctctgttctttctctgtttggggctgagtatctggtggtggttgtgtttctccacaattgcagctcttggcaagcagtcccttctccatggctccagctccatgggctctggaaacacttttctcctttgctatgtagcctagagagagcgcagtcttcctgctgttgctagactctggatgactcaactggatggttctcttagtcatactcctttaagtagtgtcttcactaatatctctttaatcaaaccaactgagtaaaattctgattcctgatggatacatgttaaaccgaaaacacacattataaattttcttgtatgtatgatgtttttcataattttaaaacataagtgaaaaaagtgaccatagaaaaatatgcccaggaaattgaaaaaaaaagtcttggtatagatattggacacattttataaaatgtggagtaagagggttaaaggaaatttatttcagaatcaaatggcatataactttaactggtatgtgaattattttcagttgtatgaatttgtgaatatatatgtgtacatttttatgcatatatataaatatgtgttttatatcatcttgcattataacataaggatttttatgttgctacattgcatttatatttaccatttttaacagctaaaggattttcaataagtgtgtatgtaacaacttccattgctggatatttctcagtatatatatgtatatatacatatgtgtgtatacatatatatatacatatgtgtatatatacatatgtatgtatatgtatatgtacgtatgtatgtgtatatatacatacatgtgtgtatacgcatatatacatatgtgtatatatacacgtatatacatgtgtgtatatatacacgtatatacgtgtgtatatacacacgtatatacatgtgtgtatatacatgtgtgtatatacacacgtatatacgtgtgtatatacacacgtatatacatgtgtgtatatacacacgtatatacatgtgtgtatatatacgtgtgtatatatataaacacatatatatatgcacatgcatatgtatacactgagttaagtagtataaatattttagagaaaattgatgtaaaatcctcaactcatttgatgctccctatcccaggacagtaaaaattgcccaatatttccttggacctccataaagaagcagtttttcaaaaaataaagtgtttggaagtttaagatgtgcctagcagtgtctccttttaacagagatgctttcacaaggatttgaatttccccattgagctgggaaccaggtttagccaagaacttcggtctgtgaaggactgcaaatagttgcacagtgtggggctgaggctagaacctccttaatattaaaccattctgggatggtgctccccaaattctggattttaaccttcactccaatcctggggcacctctgtagcttgggcatgacctggacacaagctttgtgtaagccttctttggacttcatccattcctcaacggtgacaccatgtggcagtgtaatataatggcatcagtggactcagatcctgttctctccctacctagagatttttaagattaagatatgtaattcacaaccataaaatgtaccaccttaaattgtacaatttattggtttttcatacattcaaaaagttgtacaaccaccaccattatctaattccataacattttcttcaccctagaaagaaacctcatacctattagcagccactccccaaactccccattctccccattcccccagtttctggggacccctaacctactttttgtttttatagatttgcctattctggacattttatataaatggaagcctacaatctatggccttttgtgtctggctccttttacttagtatgatcaaggttcatccaagttgtagcatgtaccagtacttcatttctttttatgtctgattaatgttccaatgtatggatataccacattttgtttatccattcaaaattgtggggcatttggattgttcccattttttttgctgtcataaataatgctgctaagtttttgtatgaacgtatgttttcaattctcttgggtatatatgtaaaagcagaattgctgggtcatatggtaactctgcatttaactttttggagttgaacaaatacaccatgccagcagtgaataaggatgctgatttcactatacctttgcacaatagttaagagcataaacactggaaccagatgtctgggttcgaatcccagctgtgctatctcctagctgtgtcgtttagacaagttactaaagctctgtgcctcagtgtccacatctctaaaatagaggcaataatagtaccttccttacaggattgttgtaagatttaaatgagctaatatgtgtaaatcacaaaaatagggtctgacattttttaaatggtatatgttttaccattgctgctattttaatctttattataattattgtgttttgttttgttaatttgatagctttaaaaggtaatgatacagtttattgatgtttgttatgaaaaggagtaattggagaagataaaaatgtaaggggtaataaagtcaaggaaggttttttgagctgaaaatgattatatttcagagtgtaacctgaataaaactgaggcttcacatggctcagtccatgcatgtaatagcattctaagaaaacataaactgaatgaaaacgtaaactgtgaagcatgaagaataatgagggtcttcaccttatgctttctgaaggagtccccgcaaatgcttcacacagcatattgaacaagaaactcctaaaatcttctctagatatttctctctttcctattttttcccactgacagtagcaccttatatctatcctcctcaactgcgaggtcactacagcactatactaagcccctgttaacttccttctcttgaaacccatgcaactcacatgatcctattctcagcctgtgaatctcagcctcctgcaatcctgtgaaattcaacttggtctcctactctgaatgtgtataaaaataacagagaacagttcctgaactctgatgagtaaaatgatctaccttattacatgtggtattataataaataaatatacattaatttctttccccattttccagcacacagctcctaaaagacttgtaacttcctgagtgataggtatgctaggtaaattttttgttctatgtgaccttcgactccagttcttgacacagagctcctgatcccttggaatttccatagtgataggagcatctttcattctcctgaagtaacttggtgggcttctggatgggagctggtcacaagaatgaccaagccatgattagaagcttggaactttcacctcctacctcatcctgtgaaaaggggagaggggctgaagattgaggtaacaattgctgatgtgtacatgatgaagtccccataaaaatccctaaatgaggggatttggagaggttctggaggtgctgaacgtggaggtgcttggagggtggcctatccagttcatctccagagttcacacactcacctaagtgctgatgcccacctgatggcatttctcagcctccgaggctttccttctttgtacttagtcaaaagaatgctctaatccagtctatcattgatgggcatttgggttggttccaagtctttgctattgtgaatagtgccgcaacaaacatacgtgtgcatgtgtctttatagtagcatgatttataatcctttgggtatatacccagtaatgagatcgctgggtcaaatggtatttctagttctagatccttgaggaattaccacactgtcttccacaatgcttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttgtctgatggccagtgatgatgagcattttttcatgtgtctgttggctacataaatgtcctcttttgagaaatgtctgttcatatccttcgcccactttgtgatgggattgtttttctcttgtaaatttgtttgagttctttgtagattctggatattagccctttgtcagatgagtagatagattaaggaaatatggcacatatacaccatggaatactatgcagccataaaaaaggatgagttcatgttctttgtaaggacatggatgaagctggaaaccatcattctcagcaaactattgcaaaaacaaaaaaccaaacaccgcgtgttctcactcataggtgggaattgaataatgagaacacttggacacatggtggggaacatcacacactggaacctgtcgtggggttgggggaggggggagggaaagcattaggagatatacctaatgtaaatgacgagttaatgggtgcagcacaccaacatggcacatgtatacatatgtaacaaacctgtacgttgtgcacatgcaccctagaacttaaagtataataaaaaaaaagaattctctaatccatggaataagtgttgaataatgaaattctgatattgtgtttaatgatatactgcactattcagaatatttgtacttaccttcgagtctctcttctaaaagatgccaaacccccttacacgaagtagaaaacgtcaaatatctaaatattgtatcttaataatgttcaaacattaaatgtttcaaatattccaatgtttagaatcataaaaaaaaaacataagaattgttttaaaaaaatgctctaaacttaacccacagcccttcttgtgaatttctccaaaataactggagcctggttaatagcaagcctcaggagcatggctttgaaatactgtcaacatactgccaccaatttctccatttccagaaaagactgtaattttttctttagaaatcatgattttcttgattggtttagactggtttccagtagttcacttaccaggaaagtttctgttttgtttttagacttccttaatttagagaatgcacataatattgaaactggctatagtatcctactctggaaaagcatattaaatacatacaaatatatatttaatgtatataaatacaaatatatatgtaatgtatataaatatatacaaatatatgtgtgtgtgagtatgtatcttccttgatttccttttatccattaccactaatatccctcaataagtcctactggttctacttccaaattatattttgaacatgctctacagaaacagctcctaaagattttccagcctccatgaatgtaagtcccctccatattccattcttcgtaccacagctagagtggtatttttagaacattcatcaggcaactaccctgctctaagccatctggtggcttttcattgcaagtagaatgcaacctctcccctagtcctcaaggctcttcatgatatgatttgaccctcccatccctcttcctcactctctacccacaattctcttcttttcatccttggaacttgccaagcttgttccacccgtatagtctttgtacctgtctcttcccatggccaaatatgctcttttggcagatctttccatggttatcttcatgattcatttctcagatatcacctcttacacatttcctgaccaccataactaaaggaacctcacacctgtgcactataccatattgctctgacttgtcttcttttttcttgtataggacttttcggtatctgaaatttttatttattaatttctgtttggaacatatctctctcagagcagaaaggtcttgctgtcctttcaaggaaatggtggggaaaagaaaaattctcattcttttatgatgagcctacaaaaataaatgggttaaatgggttcttgatccagttcaccttaagtgtggttaccaaaggaaatgattcacaaggtgactatttcatttgtgtgacactcacttatgttattagttctaggatattaaatcaagaaatattttctaggatcccctgaaagagtatctctcaattgtaaactttatctttagtggcattttgttgatttattgagattccctagatttaaaatatttaccacagagtgttccccaactcccacagcatttatccaggccataactacttatgtctggatttatgaacttattgtgggtgggggaaattgttggaggtctcatctttgttttaaagtacctgtggcatggggtctgccctttgaaggcaagagctcttcacctgcccagctcttccccagcttaggacaggaaggagagagacacagtgtgagcgagagaagcatctgattgtgagtgtcagatgaggacagctgctactctctggtcacccatacatgttaattacccctgtcatttaaaccattgttttgtgtaactagaacaaagtattctttccacgaagtctgtttgacacgagacacatataggatgtgagtctatgacaagggtaggggcaacaaatgtgaggggttggatggaaacagaggaagagaaatgagcattgcatagggcagtggtttaaaaccctacatgatcaaaaatagaacctggagacaaatcttgatattgtctttatacataataaaatgcattttaaaatattcgatgcaaacaaagcagtttgtcatgtcttttgttttgagtctctttagtatatgctgcttttgaagatcaagaacatttactggaaattgctccttcaccaggaatttgctcacatctcttcaggtccacttataagatcttgaaatcagtcctcctgagatcagtacaaacgaggatcatctctcctgctttagaagcaaaagtggcaagcagggtagacagaggcagaaggaaggatggtactgataaatcagccaaattagatggaagaaagcgaattacagctgtacttgcaaagaactcttggctcattttttcccttaaatattaaatcactagttttcaaaacttcaaatgtgaacatgactcacctgaggacaatgttaaaatgttgacctccaagaccctgcccccaagtttggatcccaggcagaaccctggaatctgtattttaaacattaaccccaagtcgagtgtaatgcaagtaaccatcagagacactctgagaaacagcacattggcaatgatgaatttatatgtctaaaaatgaatagagtagatgttacatgaataggaagtggtggtattcaagatgaccatagtatctagctcttcagccctggctccccactgctcttctcccatctcagcacttctccatctatttcgtccaaataaaaaaattcacacagagtttcaggacttaaccccccactcattaaccatctgttttgctttacatatttttctgaggtaataaaatttctctttttctaaacacagcctgtttttcaatctccgggtagttgatcaattgtatgggaaaatgaatggctgaagggtagaaacaggtgggaaagatgaacaaaaacacgaatcctcacattactaatacgcaaatcactgagcagcaagctgagcaaataccctcaattcccatcagcaactttagagaaaggcaaattccgtttgcctcattgatcatttaggtagaccctgaacactgctttcataaaacaaaaacaaaatacccatccccagtttaaaaaattattcatagatcatccaggccatctaggaggatatgatttaatcctggctacttggtaaattatttgcccaagttaactcagctagttagtggtagatggctctgaagccagttgtttttttttgttttgttttttgcagacctcaagagtcatgatgaactagcagatcataaagtttatgccctgggtcttgaccatttttagaaaaataaaacattaaatgaaaatatcagagggcattgcagatagtagatctaagtattttttcatgaaacttgttgtacatgtgtgtgtcatacacagactatatatatgcagtacctgtaaactgtattgccacataatgtctatattttcctagaggtcacagtcaccaaagttgggaagtcacccaacttcgggaactttgggaagtcacccaaacttacagtcaccaaaattgctctattctactatgtgacctcaaaagtgatttgaaagaaggaacatctgagctgggcccaaaccctattgcaattttattggggccaaagagaactccatgctcctgccaaatcaaggcagtgtcagcctcaataatttcccagataaaaataaaaatctgtgatacaatcagaatgtgaaaattcttattttggaagcaaatgtcataaccaatgcaagggctatctcaatattcattcattatgcagtattttgaactgcagttgaaatgaataagaaggaaaggcaaacaacgaagagtccaatttctcaatttagaaaaagagaaaaaaaagaaaagggagcacacaggcacggtggctcaagcctgtaatatcagcactttggcggatcacttgaggtcaaggagttcgagaaaagagagcacctagaagttcagcgcgggataatacttaagtaaattatgacaccatcgtctgtcatcttgggcccattcactaacccaaagctttcaaaagggctttcttaaccctcacctagaataggcttccgcagccttaatccttagggtggcagaatatcagggaccctgagcattcttaaaagatgtag

SEQ ID NO: 371 - DNA, 30001 bp, Homo sapiens
  Alternative Promoter of CD274 and CTCF Binding Site
tctgagaacccaaaggagtcctaaaagaggaatggaggagcctaagaataaaaatagtataataaaacatttcttagacacattgaccttggcctatgtcaaagttcagtctgggtttgtcttataacacaaggagtaaaagtaccattgttctacctctttttttaatacttgaaaaaaatttactgtggatgcttttctatgaattaaataaccttctaaaaaatgttttcattgctgcattcgattagattgggtaactaaatgaaattaattcctcactgttgggtataaaggttatttacagtggttctgtcttagccattcactgaactcattgcatatatatctctggaatattgctgattgtttccttcaagtaaacttagaagtgtaactacttagtcaaagagcctgaatattttaaaggccttttgaagaaaactgaaaatgctttccagaaaggatgtatcagttgacaatgacagtcgtcaacagtatttaaggagaactatgatactctgaagaaaaacttagcctttctcagtaaaagtaggtaggcagaggccacatgacagcagttagagtgtggtcttcaaggaagtcacagaaatactgtggggaattgaaaccccatgtggaaaatgtacaagagtgtctcagtgtgactgagaaggaggttgggcatggggtttcatggagtttaataaagtttggtcacttagtagaggtttaataaatcaactgtcttaatctttgatcctacttaagaattttttttttgtttttgtagagatggggctcttgttatgttgcccaggctgttctcgaactcctagcctcaggcgatcctccctcctcaggctccagaagtcctgggattactggcgggagccaccatgcaggcctcttgctcctacttttgagaaaggaagtttaaccggttttttttgtctttttttttttttttttgagacagagtctcactctgttgcccatgctggagtgcagtggtgcaatctcagctcactgcctcccgggttcaagtgattctcctgcctcagcctcccgagtagctgggactacaggcacctgccaccacgcccagctaatttttgtatttttagtagaaatggggtttcaccatattggccaggctgatctcgaactcctgacctcaggtgatccgcctgcctcggcctcccaaagtgctgggattacaggcatgagccactgctcctggctgcttaactttttctctatctcatcctcctacccatcctacccttggaagatagagaagtagtattagttccatagtgttatactgggcttcccccagggacaaacccacttccccaacctgaatgagccatcacttcttccccagtttacatttcattgctctttaaatgtctccattcggatatgggaattcacatatggtcataattcttacctgaagaagatgtcagtcttcttctcttagaccaactgccctgatatgaggtttagaggttaaagaacatgtgtgtatttacatgatctttgtattctgccttttcgtccctcactaatgacagctgcaccccaaggaaatggagctgtggaagagagggtttgataagaaattaagtaaatattggatctaatccatcaccctccaggaagcctttattactcctaaaaatttcaaccaaattcattaaaggacaagaactccaccagagtaggccataaacattggcaaaattagttgtaatccatgactagatttaatgtccctttgttttattcccatatggttataatgctttgcttggcattaggggtattttaagttttcttctgcctagtaagtgaatttgtgtttataatacaataatcataaaatatcacattaatattttataactgtacagttataaaatattttataagtaatatttatattttataagtaatattttataactgtacagttaactctggcccaaggaaaagatagtctgatagatgctgcagccccattttagcaaatgtgacctcacaggcctgaatgccatcgctattccacatctacaggatagacggaaaggaaagaaataaaaaaataggtacctaacactggcaagaggatgatgactcatgttatttcacttaacctttttatcttttaacatgaaggactcatacaggttgataagaaaccagtgacataaacagaccaaaaaatgatcagatctttcaaattagcaaaaaaataatattttttaaacaatgggtgaaaatacagtgtaacagtaccaattatcaacatgtgttgagaaccagaaaaatgttctttttctttgatcagcaacactatttgggaaaatctatcctcagggcctagcctggggccctggcacacagtaggcactcaacgaatatttgctgaacacacaaatacttatgatattttaaaaaattggcaacaatctgatacctaacaatagagggattaaatattatggaactgttaaataagatgcttatgaataccatgcagtaagatgggcaatatttatgccataagctttaatgaaacaaatgggtattaaatgtatgataaggttataaattactttttaaaagattacagggaaaaaaattgaaagatatacactgaaatgttttttgctcacagtggtgacaaggtttctcagcactggcactgttgacgttttaggctgtatgtctttgctgtgggaggctggcctgtgcactgcagggtgtttggcagcactcttggcctctgcccctagatagcaatagcagtcctccctcaaccagcccaattttgacaaccaaaaatgtttccaggcatcaccagatgctccctgggtgagagtgatgaaatagtaggggattttccccttcttttcttattttctgtaattccattatattactttaataataaagaaaaaaacataaaaaataaacgaatgttattattctacgtcagtttggatgtttggactccattttggggttctttccattatatcacttggtctgctaaacattctacggtttggtaaggtgaagtgattcatgaaattttggttttatttttttcctgatactaaaaataaaacattctttcacttggaaatttggacacagaacaccaaaaaaaatccataatctcatctctctttttctgtcttttccttccttttttccctttaaaaacaataaagagtgaaacctacctgttctccctctaatttaattcctaaatataatcactgtcaatatcttggacatttcctgtgtctaaacacacacacacacttttttttttcagcaaaagtggatttctgctacatgtagtgttctgcaacttactttctatgtgtttacaaaatcagtacatgtacatatgctgaattcagtccttaatggtattatattttgtgaatataccaaaatttgtttaaccacttagacaatctaggatattctcagtttgctgttatgagcaatgctcttcctttacatatacagacatatatatatatatgtgtgtgtgtgtgtttttgttttagtaggatagatttctaggagagggtgaaaggtcttatgacatccgcatttacgattgtaataggaagtatcaaagtgccccctaaagaaaaaaatcctcccattagtgggtaagaaagcctatttgttcatatcttcacaaacactaaatattagaaatatttacaattgtggtcaagctcataagtgaaaatggtatttcatatcttatattttttattgtgagattgaacatctttcatatgtttacatgtcacctgtatttcttattctctgaactatatgttatgacctttcactttttttcctcatgggttatgtgtagtttgtatagttgtcttattgattgttaggagctatttatatattaggaacattaatctcctgtcttatatatacgtggcatcgattagttgatcatttgtgagttcatgtctgtatacaaagattggagaggcactaagagggaaaacttacctctttcttatcaaagtttgtaaatatatgtataacagaagagggagaaaatattaataaatgcacagattggctgaaatagagtataaatcttttactcccctacttcaacataaactgcaaaaggagagtgacttttctttcactctgacttccgtattcctcatgcttaaaatagtgcctagcacagaagaggtgctcaatcagtgtttgctaaacgaaataattagtcacatttcaagcaggatgactaaatgaagaatagaatctaggcagatactctggaagagtggctgtgagtcattcatatcttagtatgaattagtcaaatccaactctctccccttcccactccccactgttagtagaagaatctgtttattgagagaatagatttataatttagaataagtgagaggggcagaagaggagattttgaaggatggcacctgaaggaggactagcatggctgagacagtgaagtggaagccttgaatagctaaagggtaagatgaaagtatttagctgtagggggaaaaagcattgacaggttggaaaagtaaaagtcagattctccttgctctgaaattttgtacagggcaggttctactaggtatgttacaatgcagaaaaaacatgaaataattgagaggaatttggtgcaatattatcttcttggcttcttttgagtgggcagatttttttcacggcctgtaactataataaatttgaaacttctcatcttttagtaacttttttcacttaagtttatgtggctgtgggcaatggaatgaagatattgaacttccaattccctgttgggtttccacaattacaagtcaatcatgactggttattagaagactatttcagttagaaccaccaagtcccatattgtcatattgtatgtttaattattaagtgaagcagtcttcttttcgtgttttccataattagggcattccagaaagatgaggatatttgctgtctttatattcatgacctactggcatttgctgaacggtaagacaccaaatccttccattaggttctatattttaaatattttaaccatgagtttaaaactaaaatgatcatttaaaatgcatgcaattttcttatagagagaacattctattctttcttctactttacacaatggcaaagtcttctttctactttacgcaatgataaagttacctgtgtcattttgtaaaaatatagagaatatagacaaattgaaagacacaaaataatctattacccatttcccagggttaactactgaaaatatctggggaaatggcctgtatgtatacatttatttgtttgctttcaacaaggccaagatcctttgatctttcagtcttggttgctctgtgacatgcctttcctgatgaggatactttaaggaagaattgtaagatacatggaaaatgtcaggctaacacagtactggcatcaccctgtgctctttcctgaactccataccaatgtacttcttgccagaaaactgatcaaaagtttagggaagtaaaaagagatgactgttagaatctaccattccctctatgtaggaagcaaataggtgtcctgtcaaaggacattctggggatgtctacatgaaaccaagtctccctggttgtaaggactccatctccatataatatttatacagtaatatatgtttataaattgtgggggcaacttgtttagctaattttattattctgctattgggacactgtgtctcagcatgagatatagtgtcccaaaacatatttcaagcccattggataaaatatgtgtttagcaagttcttaaatataatgataacataaccgaccagataaagtgatttataaacgctgtgccaattttgtaaatgtttcgaggaattttcccttttctgaagattgtccttctttctttttagcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatggtaagaattattatagatgagaggcctgatctttattgaaaacatattccaagtgttgaagacttttcattcttgtaagtccatacttattttcaaacagaacagcatagtctgttcattcattcattcaattcatgaattcattcacataattatccaatttcttgagcacctatttgatagtcactggaaatccagagacaaacaacacagagccatgttctacagtatgtacagttttccaaaaagaatttctagtctttacttttttattacaaatggaatacgtatacttgcaaataattcagatactgtggaagagatcaaatgaattgcaaaagtgtccctcctcccttcaccactatctcccatggcatgcagagagagtaaccattatttgtgtgtccctccagaaatttttttattcaactactatttttttattttattaggtccgtcagttttccttttttgagcctctctatatcaaatgcaaataaatatattcagaacaaaccccactgtaaggttcacattaaaaaagacttgaagtcaccctatgaagacaaaaaataatcacattaagtgtgaaagaacctattcttccagtacaggataagccatacttactgggcatatattcatcttgaaaatctatactgatgttgtcttggggaattgaaaaggaactaggagtgttagttcctcggtattgacccacagttatgttatcaggtcacttgagttcaaagttttgtgttggcactagctaagtaaaggaaaacacctctgctttcattgttgagtttcacagaattgagagctgaaaggatcccaggcaggagcagctaatccaaactcccacaaagaacaaaaatcccccagaggatcttctgttcttatatttcctgcaatggcgtccctgtcatatcccacaatggcctccctgccatttggatatcccttccatatcctgttgaaattactccctaatagtaagctgaaatctgcccctctagttgtagtcttgggattatttcatttacatgatgaccttttaatatttgactagaattaaatcatctccccttggtctttccattcctgggctaactaccatcaatctgagggctaacaatacaagtagaaaaagtatacatttgtcactgatcactgatcaattattaatcaatgatcactgataactataaactcaaaaacaaaatcatgtggggattaagagaaatgtatcagttttatgttgtatttctggtccctgatactggctcaggtaatgccactattgtcaagaagataccacttgtaaagtagatttaattttcattatattttaccatatgcttctccattcatgacatctcttgagatgttgtggtttatactttcagtttttctccagtccatccgcaaatatcaggcatctactgtgttccaagatattaaagaaatcatcatgacttagcctcatcaacagcattgctagatctgggatggaaaggaagagtataatcctggcagtcaggaagaaggcagcataaagtataagtttctgcttccaaaaaaggtctctcatcagcctgtagggagtgtgtagggaagggacagctgtccttgtagtagggaagggttttattcaggtcgtctgggctccataatatcccttgtgtatctgcagtctcctttgccatggatcaacacaataggaaatcttccggcactgatggtttttccaagggggagttcttcctggagcaaagcaaatgaccaaccaggtttgaggacctgatttgtttgacaattccattttgtattgtaaattacttaattggcattctactcccaatccatcttgtcatttgcatacagtggttttgggattgagttcagctataccaaaagtctgaaccttctgcacttagaacaaggcaaccaccaagcttcacttgcactgaggccgtgtctccaatggaaatgaggcagctggcttgcaggagcttcccaactcagggaagtagaactcctgagtcacctccatatgcaaatgatttcacagtaatgctgttgaacttcacttcccatcacagcaaatgtgtggtaacatagcttccccacaggagtttactcaccatggtattttaaaggtgaaacatttcaaaactgaaatttgaaagaatttagttttggattcactcaattatcactatcacttcgggtgttattgcacctttcttgtttgtgagtttaaatgccagactctcaggccactaactttcaattaaaagtgtttttctttaatcgctgaacctaacagcagggaaaacgaaatgttcattcagactttcagaaccttcaatgagattaggcagctgaaagatcaaagtgttgcatagttgtcccgataaagctatttggatcatatggaccaaatcgactgctgtcattccccaccaaccccatctctccccaaaattcccagccctgtttaagtgttctctgtagcatttatctctatctagtatattgtgtagcatatcatatcatacttttctgttttgtttattgtctctctcctcctagaatataaactccacaagcacaaagatttgggcctgttttataatattgttgcatccccagggcctgatatacagcagagtggtggtacgaaaagagcacacaaaaaaatatttgttgagtcaatgaatgaatgatttcctcaaataggattagcctaaaattttggaaacatgaacagatttggatatgtgaaaatttatttccagactgttcatcaggaactgttagcagcttctaaagggtacactggagcagcagtagtaaaaggaggaagaggagcagctctgctactgctactatcgagtactactacaattagcacttgcttattctgtgtgttaggccctgtactgaacactctgtctaaattagttcatttcctcctggaaatgactctagggggtaagtgcttcatcatgtaagatgagtatttttcacattttgttgtgtctgaaatctgagtgtgtctttcaatgatggaatctttgattccatgataagtggtattattcccattttaaggatgaggaaactgaggtccaaagaaattaagtaatttgcccaaattcacccagcctagaaaatgataaagctagttctaaacccaagcagattagctctgaagtctgggcccttaataaccactttttattgcctatatttgtacctctggtgtacgtatcaagttatatgttgacttcaaaactatcatgaccttttcttggttttgattgtccaacattagtatagtgttctgggtctgcaaaaattttgattactcatctcatctgtaaaacattttgaactcgtgtgtttgtgcatgcacatttgtgtgtaattataaaaattttactttctgttaatatataagttgtatcataagaaactgccgtttttgaagagcaaaaaaaggttgaatgttaccagttacatctggttcaacctaatagacatttgtacaaaaacagacattttaagaggttgaaataaaaatttaataaacaatattttcagtttttactaattgtgatgcttcactatcattagctaatatgtcaaggcataatataccttagggtgaactttatcattaacaaaggtggatggtgtcaataatcttgaggtttgtgtttttttatataacactgcgaggtctaattaagtacttactgtttaccacctcatacagtggccgataaaaagtgtcacttctgctgtttcctctgggttgtgcttgaattattagtattatcttcagtcctcagtttctttgtgggaaactttttaattagttgtttaattttgtaagatggttagtttagtcaaaattagataagagaatttgaaaatccgtagctaccccaaagcaacctacacataagaactattatttttgtgttttgaaatcataattttattgatttccagtgtttccactggtagtggtttcattgatataggagtatcaaaacatcactcattatttatttcagtttcatttgatcctagccgttttgtattaactctctgtgaagaaattacctcacaaatctattgctgtccttggtaaaggaatggagaattaaggctctagatcattagtggttacactatagtattagaagtaaaaaaaagattataccaacaaaataagaacatgttaatgtacttgtaatgaataaacatgaataaagctcttatgctatataggtgcactaaacaatctactagaattgtcagcaaactacgtatcttaatcctgaaagggtcccaaaccaatgatctaaaattgaatcaaactttcttccttgagcataattacttaaatgatttattaaaatagccagcatttaaaagcttaaaatgtaaatatcataatgtggtatcctagatagcatcccagaacagaaaaaggatattagggaaaaactggaggaatggaataaattatgcagtttagttattaataatgtactaacgtccttagttatgacgattgtaccatggtaatgtaagatactaacaatagaggaaaccgggtaaggagtatacagtaactctatactatctttgcaacttttttgtaaatttaaaacttctaaaataaagaacaaatttaaacattaaaaagtatcaccaggaacatatatcactgtttacagatgaaatactatgtattttcatatctaatttctgatcattgacttcaaatcagaaaagtgaatgacacctcaaaatcaggttttctgtttactgaagtctaagaaaagaaagcataccagctggagagattcatgtttataaagacagatttataacaacaaaaataaaatatccaagaataaatttaagaagaagcactttactgagaaacatatgaaaacctgaacaaatggagagggatattttgtatttgaatagaaagacttctggtttaaagataattctctttaaattattttttgtagaaatttaaggggtacaagagcagtgttgtcacatggatatattacatagtggtgaagtctggggttttagtgtaaattaatctttacattttgtttgagcccaataaatgtaccaacatgatttttatagaaagatagtcattcctattaatccaaacttgtcccaactttgaattgaattgaggcagagctagcaggtgttccccacggctgaggcatctgaacattaagcatatccctctgagaaccagcctgcattgatactctttctaatgtggacagcatcaagctatgtacgtagttctgtgctcagcaaaagccctgacttctttttgtttatgtcctagccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataacactatgtttacaaaatatatcctaattcctcacctccattcatccaaaccatattgttacttaataaacattcagcagatatttatggaatataccttttgttccatgcattgtagtactcattggatacacatagaataataagactcagttcacactcttcaggaaacagataaaaaactaagaaacaaacaaaaaacaggcaatccaacaccatgtgggaaatgctttcatagccgggaaacctggggaatacctgagaggaatactcaattcaggccttgtttcaggaatccaaatcctggcacatcagagctgcttccctctttccagggtggcaggaaataaatggaacatatttttctatcttatgccaaacatgagggaccctttctccccggtgcctctcccaaggtagtctacaatatttcaactctagcagtctgcttagtgcatagaacatgaggctgtgtgtccctgggcaaattactagacttctgtgtgcttcactttccctgtaggattataatctactgagcaagcttattgtaagggtcagattagcaacagtgtatgaaaatgatttgagaccattgcctgcacaaattcaactatttttttttatctcactactctacagaagtaggtagggtgggagacagagtctgatgagaggctcagaatgtgaaagaaagtgaggcgagtgagcatgatatttaatataaacacaaagatattctgagaagagctgctcactgccccctcccccaatacatgttgataggaaaatgccacgtacttcagcaaaaacaactgaaaaattagatagaaaagtcaatcaataggaaaagataatccaggacggtgttgtgaacagaaagagggggaaaaaactttagaaaatgatggggatgctcttactggggtacgagtcctcaggtattgaactggctttcagtaaaagctagattagtgggttcctgccatttacaagctgttttatgacaacttacttgttgggtggcctacagtaactcacctaactgcactgagtctgtttcctcatctgtaaattggggatttttttttaaatacctggcatgcctaactcataaagttgttctgaaactgaaataaaacatacgtgaacaggcattgtaaactgtaagttacggaaaaagctggctgttgttgtgtctttaaagtttcacctgggtagtcaaagatggatcatgggtctcagtggagagctgagccaggcaggagctgactaagggtgagaggtgggagttagcagcctctgaacatctgtgtaccatgggaccccctttcctcctgcatggtaccccagacaaggagcctagtaagagatactaatggcttgttgtccagagatgttcaaactgcagagaaagataagacaacaagcattggcctccaatcatgatgacagataggaggaggtgggagctccttagcagtgctggttggccttccatgttctactgtgggccatctctgccatgtactgtaggctactagcttctatattaaagaatgcaagaggggccaggagcggaggctcatgcctgtaatctcagcactttgggaggccaaggtgggcagatcacttgaggtcaggagtttgtgaccagcctggccaacatggtgaaactctgcctttactaaaaatataaaaattagctgggtgtggtggtgtgcacctgtaatcccagctactcgggagactgaggcacaagaattgcttgaacctgggaggcggaagttgcagtgagcccagattgcgccactgcactccaccctgggcaacagagaaagactctgcctcaaaaaaaaaaaaaaaaagcaagaggaagtgaaataatcaaggccgccatttaatagtgagcagccactccatgtggtactgtgcaagcacattataaatattagcctcacaagaaatgtattagcatttgtattttgtacactggttaagtatcttgcccaagacctcaaaactggttaagggcagcagaatttagccccagcaccaccttttcaaagcctgggcttctcacacttctccatgctgttcccattttaacacaggtatctcgccattccagccactcaaactttggcatttaagaaaattatcctaaagctaaactaaacttcaaggatgaccattctcctgaccccttcccatcaaaattttatctttagtcagtttgttttcgttttgttttgtttttcagaactacctctggcacatcctccaaatgaaaggactcacttggtaattctgggagccatcttattatgccttggtgtagcactgacattcatcttccgtttaagaaaaggtagtatttccttaattgcagtggtctccactgggggtgaggaaggggtgagaattggatcatggctgcaaggaaacccgacttaacctctgcaaggtggtgcaaaggcattccactgttcaacagcaattatattgaagctgagtgggatcactgggtgaagatgaagcgtaaggggtgaggggcaggagaatgggtatggatggaggtagaagatgcagtgtcatacagtttttttctatcatgaaaataaccacagacttacagaagagaaagagctaaaatgcccgtcattttcagttgcattttagtcttgcattagttgcaaccagctggtttctgggtaccctaagtaataaaaatagttcctctgtagaactgtagtatgtttaccatagagtattttgcaaaatttttggtagaggatgttacataatttgcatgtgttcatttctccatttacctgtgggaacaattaaaatccaggaaaatgagtatattcaaataatttcctcccatttaagatgagtcagagtaaataattcctccaatacttagagaagtataccaagagatccagtgatggtatagagttgtctgatgttaaatagggaagtagaatatggaaggggattccaatagtcgttgaaaaattccccataaccccttacatgggggaaagtagtgttaactgagagagtagagataagctgtttccaaaaattatattcttaacaggactgagatagccagaatataaggatcaagtttcaatgacagtaagatcctgagatggagttgatttgcacaaagaaataattgttgccagcatgcattttgaatatttctctggaaaaaaagattagttggcagtagaaatggatagaaatcaatagatattaaaatacctcagaatttggttcatctctgggaaaagatgaaaaataaaagtgtatactcctcaagaacatctaggatcaaaagcatgtgccctacactattgaattaattaacctcataagttgggacctgtggaataaggatgtccaccagacttcctagggattacaaatgtttcacagaacttgaaatttaaacttgggtcactgtatgggatgtagagctgtgctatatggaaataaaaatgatttctttttctcaagggagaatgatggatgtgaaaaaatgtggcatccaagatacaaactcaaagaagcaaagtggtaagaatatcagaaggaattgggaagtaaaagtcaaaggaaacaaaaagctaaagcaataacaaagagaaatccatcagtcataatctcctctccttttaaagaatgctggttcccctttgcctcacagctaacacaagaactcctccaccgtctgaggaggtttaggagcagggaaggggaaggagtcagcttcatttgctaatcttctgttgccctgcaccctagcagctccttgcagcaggggacaaggatgacttaggtggatggataattaattgattctaaaatattgtgtgtcagtattgtaatactatgttaattgcaccatgcacggtatctcatttaatcccccaccccttgccattaccaaagagagagagagagagagagagagaaatactagaatttatcctcattttacagtagagaaaacagagggtcaagaagataatgtaaagtgcccaagaacacacagctgatcacaaaaatcaagcttgggggccattagcctaaccacagacccttactcttaacccatctgcttcaatccattttgctacaaatgtttacatttataagcagggcagaaaaacctcatccaggttattgaactaagaagaaagttatattaaggtttctaatttttttaatgtagttagaaaccaaacttaacaatgagcccaagtttaaagcagtctaattaacctggacaagctcaggcaagtttcattctgtggcccatagcatcatctgtgttgtaaagctaagtagcaaatgttgtttgggtcatgctgggggacaagccatcccaatttgctcaggactgaggggttttccaggatatcatgtaaggataattgggtacaaatataacctgctgctttctctcatttcaaatttatcatttatcatatcagcaactatgagttatgttttttattagatttcttgttactttttccccagaccacttcccatgaaattaatatactattatcactctccagatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagttacttggaatatttgcagccttgttcctagttcttttttcattgcttatacagcatgtttttatacagcatgcttttgaatcctgcacaatgaaaaaagtatcaaaagattttattttaaaaaagaatgtattgaaaattttcattctctctcattcggcagcttcctttaggaccataccaagaagagtcaaaatcctgtcatctacattgaagatctaagggagagagggtgggagagaaggagtggaacccaatagaactatagggaaacaaagggacttacctctaagaaagtacttttcccagatctgtaaacgggtatgcaatccagtgtgtaggaagatagatgtattgcagtcttcaagttttgaaaataaagcgaggaaactagaactaagccaagttgaggattaagggctagcaatggttaggaccatagatctgtggttttaaacaagcatgacaaaacttatcattcaaggaagtatagaccttttaatgtgtcatccggtgagattttagtcatgaaattccattttaaaagactatcacttatttgaatcagatactcttaaaggattataatggctatttctaagaatatgtgtttgactctagatgcttttgtttgtttgtttttgagacagagttttgctcttgtcacccaggctggagtgcaatggcactatctcagctcactgcaacctccgcctccaggttcaactgattctcctgcctcagcccctcgagtagctgggattacaggcacctgccaccactcctggctaatttttgtacttttagtagagacagggtttcacaatgttggccaggctgatctcgaactcctgacctcaggtgatccacccatctcagcctcccaaagggctgggattacaggtgtgagccacggtgcctggcctctggatgttttcagtagtaatgatgatgcactatttatgctagcccttgggcagtcaaagcaataaaaatgtgtgctagacatcaagatatctggccttcctaatcaggaaaggatatggagaactagtcttcctggcttgccttggtggtatggaaattttgtgacacttgaggggtctgtattatagaaaagttaatatgaaaatggttcataagctttcattaaacttttgttctagtcccttttacaagtgtgtgcctgtctgccacaagtaggcctaatatattttttaagttttatttttaattgacatataattgacttttttttattattatactttaagttctagggtacatgtgcacaaaatgtaggtttgttacatatgtatacatgtgccatgttggtgtgctgcacccattaactcgtcatttacattaggtacatctcctaatactatccctccctcctccccgtaccccacgacaggccccggtgtgtgatgttccccatcctgtgtccaagtgttctcattgttcatttcccacctatgagtgagaacatgcggtgtttggttttttgtccttgcaatagtttgctgagaatggtttccagcttcatccacgtccctacaaaggacatgaactcatccttttctatggctgcatagtattccatggggtatatgtgccacattttcttactccagtctatcattggtggacatttgggttggttccaagtctttgctattgtgaatagtgctgcaataaacatacatgtgcatgtgtctttatagcagcatgatttataatcctttgggtatatacccagtaatgggatggctgggtcaaatggtatttctagttctagatccctgaggaattgccacactgtcttccacaatggttgaactagtttacactcccaccaacagtgtaaaagcgttcctatttctccacatcctctccagcacctgttgtttcctgactttttaatgatcgccattctaactggtgtgagatggtatctcattgtggttttgatttgtatttctctgatggccagtgatggtgagctttttttcatgtgtctgttggctgcataaatgtcttcttttgagaagtgtctgttcatatccttcacccactttttgatggggttgtttgattttttcttgtagatttgtttaagttctttgtagattctggatattagccctttgtcagatgggtagattgtaaaaatgttctcccattctgtaggttgcctgttcactctgatggtagtttcttttgctgtgcagaagctctttagtttaattagatcccatttgtcaattttggcttttgttgccattgcttccagtgttttagtcatgaagtccttgcccatgcctatgtcctgaatggtattgcttaggttttcttctagggtatttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtggatgtgtggtattatttctgagggctctgttctgttccattggtctagatctctgtttcagtaccagtaccatgctgttgtggttactgtagccctatagtatagtttgaagtcaggtagcgtgatgcctccagcttttttcttttggcttaggattgtcttggcaatgcaggctcttttttgattccatatgaactttaaagtagttttttccaattctgtgaagaaagtcattggtaacttgatggggatggcattgaatctataaattaccttgggcagtagggccatttcacgatattgattcttcctatccatgagcatggaatgttcttccttcggtttgtgtcctcttttatttcattgagcagtggtttgtagttctccttgaagaggtccttcacatcccttataagatggattcctaggtattttattctctttgaagcaattgtgaatgggagttcactcatgatttggctctgtgtttgtctgttgttggtgtataggaacgcttgtgatttttgcacattgattttgtatcctgagactttgctgaagttgcttatcagcttaaggagattttgcgctgagacgatggggatttctaaatacacaatcatgtcatctgcaaacagggacaatttgacttcctcttttcctaactgaataccctttatttctttctcttgtctgactgccctggccagaacttccaacactgtgttgaataggagtggtgagagaggacatccctgtcttgtgccagttttccaagggaattcttccagtttttgcccattcagtatgatattggctgtggatttgtcataactagctcttattattttgagatacgtcccatcaatacctagtttattgagagtttttagcatgaagcgctgttgaattttgtcgaaggccttttctgcatctattgagataaacatatagtttttgtctttggttctgtttatatgatggattacgtttattgatttgcgttacgttgaaccagccttgcatcccagggatgaagccaacttcatggtggtggataagctttttgatgtgctgctggattcagtttgccagtattttactgaggatttttgcatcgacgttcatcagggatattggtctaaaattctctttttttgttgtgtctctgccaggctttggtatcaggatgatgctggccttataaaatgagtcagggaggattccctctttttctattgattagcatagtttcagaaggaatggtaccagctcctctttgtacctctggtagaattcagctgtgaatccatcttgtcctggactttttttggttggtaggctattaattattgcctcaatttcagagcatgttattggtctattcagagattcaaattcttcctggtttagtcttgggagggtgtatgtgtccaggaatttatccatttcttctagattttctagtttatttacgtagaggtatttatattattctctgatagtagtttgtatttctgtgggatcagtagtgatatcccctttatcattttttattgcatctatttgatttttctctcttttcttctttattagtcttgctagcggtctatcaattttgttgatcttttcaaaaaaccagctcctggattcattgattttttgaagggtttttcatggctctatctcctccagttctgctctgatcttagttatttcttgccttctgctagcttttgaatgtgtttgctcttgcttctctagttcttttaattgtgaggttaaggtgtcaattttagatctttcctggtttctcttgtgggcatttagtgctctaaatttccctctccacactgctttaaatgtgtcccagagattctggtatgttgtgtctttgttctcgttggtttcaaagaacatctttatttctgccttcattttgttatgtacccagtagtcattcaggagcaggttgttcagtgtttagtttccatgtagttgagcagttttgagtgagtttcttaatcctgagttctagtttgattgcactgtggtctgagagacagtttgttataatttctgttcttttacatttgctgaggagtgctttacttccaacaatgtggtcagttttggagtaagtgtgatgtggtgctgagaagaatgtatattctgttgatttgtggggagagttctgtagatgtctattacatccacttggtgcagagctgagttcaagtcctggatattcttgttaactttctgtctcattgatctgttaatgttgacagtggggtgttaaagtctcccattattattgtgtgggagtctaagtctctttgtaggtctctaaggacttgctttatgaatctgggtgctcctgtactaggtgcatatatatttaggatagttagctcttcttgttgaattgatccctttaccattacataatggccttctttgtctcttttgatctttgttggtttaaagtctgttttatcagagactaggattgcaacccctgcttttctttgttttccatttgcttggtagatcttcctccatccctttattttgagcctatgtgtgtctctgcacgtgagatgggtctcctgaatacagcacactgatgggtcatgaccctttatccaatttgctagtctgtgtcttttaattggatcatttagcccatttacatttaaggttactattgttatgtgtgaatttgatcctgtcattatgatgttagctggttattttgcgcattagttgatgcagtttcttcctagcattgatggtctttacaatttggcatgtttttgcagtggctggtactggttgttcctttccatgtttagtgcttccttcaggagctcttgtaatgcaggcctggtggtgacaaaatctctcagcatttgcttgtctataaaggattttatttctctttcacttatgaagcttagtttggctggatatgaaattctgggttgaaaattcttttctttaggaatgttgaatattggcccccactctcttctggcttgtagagtttctgctgagagatccgctgttagtctgatgggcttccctttgtgggtaactcgacctttctctctggctgcccttaacattttttccttcatttcaattttggtgaatttgaaaattatgtgtcttggagttgctcttctcaagaagtatctttgtggtgttctctgtatttcctgaatttgaatgttggcctgccttgctaggttggggaagttctcctggataatatcctgaagagtgttttccaacttggttccattctcaccatcactttcaggtacaccagtaagacgtagatttggtcttttcacatagtcccatatttctgggaggttttgttcatttcattttactcttttttctctaaacttctcttcttgcttcatttcattcatttgatcttcaatcactgataccctttcttccagttgatcgaattggctattgaagcttgtgcatgtgtcacatagttctcatgccatgtgttttcagcttcatccagtcatttaaggtcttctctatgctgtttattatagttagccatttgtctaatcttttttcaaggtttttagcttgtttgcgatgggttcaaacatcctcctttagctcagagaagtttgttattaccagtagtctgaagccttcttctgtcaactcgtcaaagtcattctccgtccagctttgttccatttctggtgaggagctgcgttcctttggagaagaaaaggtgctctgatttttagaattttcagcttttctgctatagtttctccccatctttgtggttttatctacctttggtctttgatgatggtgatgtacagatggggttttggtgtggatgtcctttctgtttgttagttttccttctgacagtcagcaccctcagctgcaggtctgatggagtttgctggaggtccactccagatcctatttgcctgtgtttcaccagtggaggcttcagaacagcaaatattgtagaacagcagatgctgctgcctgatccttcctctggaagcttcatctcagaggggcacccggctgtatgaggtgtcagtcggcccctactgggaggtgcctcccagttaggctactcaggggacaggaacccacttgaggaggcagtctgtccgttctcagatctcaaactccgtgctgggagaaacactactctcttcaaagctgtcagtcagacagagacatttaagtctgcagaagtttctgctgccttttgttcagctatgccctgtcccaagaagtggagtctaaagaggcaggcaggcctcgttgagctgcagtgggctccacgcagttcgagcttccgtgtcgctttgtttacctactcaagcctcagcaatgacgggcacccctcccccagcctccctaccaccttgcagttggatctcagactgctgtgctagcagtgagtgaggctccatgggcatgggaccctccgagccaggcgcgggatacaatctcctggtgtgctgtttgctaaaaaccattggaaaagtgcagtattagggcgggagtgtcccggttttccaggtactgtctgtaatggcttcccttggctaggaaagggaattccccgaccccttgcacttcctgggtgaggcaatgccctgccatgcttcggcgcaccctccatgggctgcacccactgtctgtcaagccccagtgaaatgaacccagtacctcagttggaaatgcagaaatcacccatcttctgcgtcactcacactgggagctatagactggagctgttcctatttggccatcttggaatctccctacccattttccataattgacatatttatagggtacagtgtaatgttttgatagaagtatacattgtgtaattatcaaatcagggtaattagcatattcttttcctcaaatatttatcatttatttgtgataagaacattcaaaatattctctcctagttattttgagttatacagtataatactgttaaccacagtcaccctatgtattagtccattttcacagtgttataaaaatactacctgagactaggtaatttataaaggaaagaagtttaattgactcaaagttctgtatggttggggaggcctcaggaaactcacaatcatggtggaaggggaagcagtcaccttcctcacaaggcagtaagaggagagagagcaaagagggaagagccctttatgaaactatcagctcttatgagaattaactcactatcatgagaacaggatgggggaaaccacccccatgatacaatcacctccctccctcaacacgtggggattacaagtttctcccatgacatgtggggatcacaattcgagatgagatttgtgtgaggacagagccaaactgtatcaccctactatgcaatagaacaccagaacttattccttctatctaactataagtttgtacctgttgaccgatctctactaatctcccctcctcatgcccccaaccctctccagcctctggtaaccactaccctactttctacttctgtgatatcaaccttttaacattccacatatgagtgagatcatttagtatttgtgtttctttgcctggctatttcacttaacataattatcctctagttttatccatgttgccacaaatgacaggatttcatttgttatggctgaatactattctattttgtgtgtgtgtgtgtgtgtgtgtgtgtgtgtgtgtgtgtgtgtgtacaccacattttttctttcttttttttttttaaagagatggagtcttgctatgttgcctaggctggccttgaactcctatcgtcccacccacagcctccagagtagctgggaatataggcacatgccactgcacctggcttatataccaccttttcctcatccattcatctgttgatggacacttaagttgattccatagcttcactattgtgaatagtgctgcaataaacctagcagtgtagatgtctatttatgtctttatttatttaactattttatttatttattctttatttaactattttaaagctgagaaattcaaaattaacttttgttctattgatatatttggccaaatttgttaagacagatacacctgtttttagaatttttcctatcccaggcttccaaagtttcaagaaaattgatataataaaccaacttattcccattataatttaaacatttccgaaattatttccattttaaaagaagttaatgtttgaccaatgaagcaattgtcaatgatggggttttattatgagtttaataatgatatttaccatttattgagcatgtaccttatgcaaggtcttcatctgtcaatcatctcttctttctgcaaatacaagacttagcaagcttggagtaagttatgaatgctaacatatgtgagatcaaatagtctctttctagggcactgaaggtctttggggacttaaaaactcgattacaatgattcagtcatataagagaaaattgcaacacacacacacacataaaacagaaaagaactatttgtacatgccaggaaacactgctctaagagttgctttattctaggtgactatgaaaggaaaaaaaaaatctaactatagagaagttaaaaaatgtacatatatttgggaagaataggaaatttcaccaaaggcctggagtcactcaaacccgagttccaatcttcttagatgtaaattaacttcattgaaccagtttactttaaaaattcttgtttttattaaaaatttcaattactattaaaattatatttttaattaaaaatactttaaaaattaaagtgtatagtttttctatttatcttaaatattcaaataattgtgaattaaagttgtgccagcttgaagatttaaagtgataggcttaataattttggaacttttcttaatgtcaaagttaactagagcttcttttctttttcaaattacacatttaaaattccggcatcagttcctttttgagtcatctaggtctctcacgtcagtaaatattgagctactgtaaagctgaagttacttacgtagtaacataacttacttaggggagatttgtaaatgtttattttggataagctatgtcttatttttgttttgcttttgagaaagatacttctcattctttgctaatttcaaacaaacagctttatagtagaaagcaattatttctataactcaagttaaataattctgtctattctttagtcaaattgaaaataagacataacaaaacaatgacccccttgccttggtttctaacttttcagaggtgaacacaaccataaatggtaactaacttacagtagtgcctactgtatccactaagcattatgtagaatacagaggtgacccagacatgcaccctgcccttaaaaaacatgaagattgaaacatattatcatgatttacaggcatagctcctcctcctccaaaaacaaaacaatacaaaacacacaaataactgtgtttgtcagaaatacagacaccaagtgttaaaatgtcagaaaatagggcagcttgaactcaacctttgcactctctagcacttgaattatattttatcaaacctttgttaagttagttcatgtattttggtgcctcagtggttctaatccaagtatagtatttttgtagatccatctgtcccagtgctgcataacagcactagaacatgtggaagagatttaacaaatagtattagctatgatatgtatatattagtatatattacatgtcaggaagtgttctgagttctttacgtgtactaattcatttagccttcccaataaccctatgcggaaagttattaccatcttctcttgacagataaagaaaccaagccacagaaagtttaggtaacttggccgaagtcatgctactaat

SEQ ID NO: 372 - DNA, 19495 bp, Homo sapiens
  Coding Seqeunce of CD274 Downstream from Promoter
tctgagaacccaaaggagtcctaaaagaggaatggaggagcctaagaataaaaatagtataataaaacatttcttagacacattgaccttggcctatgtcaaagttcagtctgggtttgtcttataacacaaggagtaaaagtaccattgttctacctctttttttaatacttgaaaaaaatttactgtggatgcttttctatgaattaaataaccttctaaaaaatgttttcattgctgcattcgattagattgggtaactaaatgaaattaattcctcactgttgggtataaaggttatttacagtggttctgtcttagccattcactgaactcattgcatatatatctctggaatattgctgattgtttccttcaagtaaacttagaagtgtaactacttagtcaaagagcctgaatattttaaaggccttttgaagaaaactgaaaatgctttccagaaaggatgtatcagttgacaatgacagtcgtcaacagtatttaaggagaactatgatactctgaagaaaaacttagcctttctcagtaaaagtaggtaggcagaggccacatgacagcagttagagtgtggtcttcaaggaagtcacagaaatactgtggggaattgaaaccccatgtggaaaatgtacaagagtgtctcagtgtgactgagaaggaggttgggcatggggtttcatggagtttaataaagtttggtcacttagtagaggtttaataaatcaactgtcttaatctttgatcctacttaagaattttttttttgtttttgtagagatggggctcttgttatgttgcccaggctgttctcgaactcctagcctcaggcgatcctccctcctcaggctccagaagtcctgggattactggcgggagccaccatgcaggcctcttgctcctacttttgagaaaggaagtttaaccggttttttttgtctttttttttttttttttgagacagagtctcactctgttgcccatgctggagtgcagtggtgcaatctcagctcactgcctcccgggttcaagtgattctcctgcctcagcctcccgagtagctgggactacaggcacctgccaccacgcccagctaatttttgtatttttagtagaaatggggtttcaccatattggccaggctgatctcgaactcctgacctcaggtgatccgcctgcctcggcctcccaaagtgctgggattacaggcatgagccactgctcctggctgcttaactttttctctatctcatcctcctacccatcctacccttggaagatagagaagtagtattagttccatagtgttatactgggcttcccccagggacaaacccacttccccaacctgaatgagccatcacttcttccccagtttacatttcattgctctttaaatgtctccattcggatatgggaattcacatatggtcataattcttacctgaagaagatgtcagtcttcttctcttagaccaactgccctgatatgaggtttagaggttaaagaacatgtgtgtatttacatgatctttgtattctgccttttcgtccctcactaatgacagctgcaccccaaggaaatggagctgtggaagagagggtttgataagaaattaagtaaatattggatctaatccatcaccctccaggaagcctttattactcctaaaaatttcaaccaaattcattaaaggacaagaactccaccagagtaggccataaacattggcaaaattagttgtaatccatgactagatttaatgtccctttgttttattcccatatggttataatgctttgcttggcattaggggtattttaagttttcttctgcctagtaagtgaatttgtgtttataatacaataatcataaaatatcacattaatattttataactgtacagttataaaatattttataagtaatatttatattttataagtaatattttataactgtacagttaactctggcccaaggaaaagatagtctgatagatgctgcagccccattttagcaaatgtgacctcacaggcctgaatgccatcgctattccacatctacaggatagacggaaaggaaagaaataaaaaaataggtacctaacactggcaagaggatgatgactcatgttatttcacttaacctttttatcttttaacatgaaggactcatacaggttgataagaaaccagtgacataaacagaccaaaaaatgatcagatctttcaaattagcaaaaaaataatattttttaaacaatgggtgaaaatacagtgtaacagtaccaattatcaacatgtgttgagaaccagaaaaatgttctttttctttgatcagcaacactatttgggaaaatctatcctcagggcctagcctggggccctggcacacagtaggcactcaacgaatatttgctgaacacacaaatacttatgatattttaaaaaattggcaacaatctgatacctaacaatagagggattaaatattatggaactgttaaataagatgcttatgaataccatgcagtaagatgggcaatatttatgccataagctttaatgaaacaaatgggtattaaatgtatgataaggttataaattactttttaaaagattacagggaaaaaaattgaaagatatacactgaaatgttttttgctcacagtggtgacaaggtttctcagcactggcactgttgacgttttaggctgtatgtctttgctgtgggaggctggcctgtgcactgcagggtgtttggcagcactcttggcctctgcccctagatagcaatagcagtcctccctcaaccagcccaattttgacaaccaaaaatgtttccaggcatcaccagatgctccctgggtgagagtgatgaaatagtaggggattttccccttcttttcttattttctgtaattccattatattactttaataataaagaaaaaaacataaaaaataaacgaatgttattattctacgtcagtttggatgtttggactccattttggggttctttccattatatcacttggtctgctaaacattctacggtttggtaaggtgaagtgattcatgaaattttggttttatttttttcctgatactaaaaataaaacattctttcacttggaaatttggacacagaacaccaaaaaaaatccataatctcatctctctttttctgtcttttccttccttttttccctttaaaaacaataaagagtgaaacctacctgttctccctctaatttaattcctaaatataatcactgtcaatatcttggacatttcctgtgtctaaacacacacacacacttttttttttcagcaaaagtggatttctgctacatgtagtgttctgcaacttactttctatgtgtttacaaaatcagtacatgtacatatgctgaattcagtccttaatggtattatattttgtgaatataccaaaatttgtttaaccacttagacaatctaggatattctcagtttgctgttatgagcaatgctcttcctttacatatacagacatatatatatatatgtgtgtgtgtgtgtttttgttttagtaggatagatttctaggagagggtgaaaggtcttatgacatccgcatttacgattgtaataggaagtatcaaagtgccccctaaagaaaaaaatcctcccattagtgggtaagaaagcctatttgttcatatcttcacaaacactaaatattagaaatatttacaattgtggtcaagctcataagtgaaaatggtatttcatatcttatattttttattgtgagattgaacatctttcatatgtttacatgtcacctgtatttcttattctctgaactatatgttatgacctttcactttttttcctcatgggttatgtgtagtttgtatagttgtcttattgattgttaggagctatttatatattaggaacattaatctcctgtcttatatatacgtggcatcgattagttgatcatttgtgagttcatgtctgtatacaaagattggagaggcactaagagggaaaacttacctctttcttatcaaagtttgtaaatatatgtataacagaagagggagaaaatattaataaatgcacagattggctgaaatagagtataaatcttttactcccctacttcaacataaactgcaaaaggagagtgacttttctttcactctgacttccgtattcctcatgcttaaaatagtgcctagcacagaagaggtgctcaatcagtgtttgctaaacgaaataattagtcacatttcaagcaggatgactaaatgaagaatagaatctaggcagatactctggaagagtggctgtgagtcattcatatcttagtatgaattagtcaaatccaactctctccccttcccactccccactgttagtagaagaatctgtttattgagagaatagatttataatttagaataagtgagaggggcagaagaggagattttgaaggatggcacctgaaggaggactagcatggctgagacagtgaagtggaagccttgaatagctaaagggtaagatgaaagtatttagctgtagggggaaaaagcattgacaggttggaaaagtaaaagtcagattctccttgctctgaaattttgtacagggcaggttctactaggtatgttacaatgcagaaaaaacatgaaataattgagaggaatttggtgcaatattatcttcttggcttcttttgagtgggcagatttttttcacggcctgtaactataataaatttgaaacttctcatcttttagtaacttttttcacttaagtttatgtggctgtgggcaatggaatgaagatattgaacttccaattccctgttgggtttccacaattacaagtcaatcatgactggttattagaagactatttcagttagaaccaccaagtcccatattgtcatattgtatgtttaattattaagtgaagcagtcttcttttcgtgttttccataattagggcattccagaaagatgaggatatttgctgtctttatattcatgacctactggcatttgctgaacggtaagacaccaaatccttccattaggttctatattttaaatattttaaccatgagtttaaaactaaaatgatcatttaaaatgcatgcaattttcttatagagagaacattctattctttcttctactttacacaatggcaaagtcttctttctactttacgcaatgataaagttacctgtgtcattttgtaaaaatatagagaatatagacaaattgaaagacacaaaataatctattacccatttcccagggttaactactgaaaatatctggggaaatggcctgtatgtatacatttatttgtttgctttcaacaaggccaagatcctttgatctttcagtcttggttgctctgtgacatgcctttcctgatgaggatactttaaggaagaattgtaagatacatggaaaatgtcaggctaacacagtactggcatcaccctgtgctctttcctgaactccataccaatgtacttcttgccagaaaactgatcaaaagtttagggaagtaaaaagagatgactgttagaatctaccattccctctatgtaggaagcaaataggtgtcctgtcaaaggacattctggggatgtctacatgaaaccaagtctccctggttgtaaggactccatctccatataatatttatacagtaatatatgtttataaattgtgggggcaacttgtttagctaattttattattctgctattgggacactgtgtctcagcatgagatatagtgtcccaaaacatatttcaagcccattggataaaatatgtgtttagcaagttcttaaatataatgataacataaccgaccagataaagtgatttataaacgctgtgccaattttgtaaatgtttcgaggaattttcccttttctgaagattgtccttctttctttttagcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatggtaagaattattatagatgagaggcctgatctttattgaaaacatattccaagtgttgaagacttttcattcttgtaagtccatacttattttcaaacagaacagcatagtctgttcattcattcattcaattcatgaattcattcacataattatccaatttcttgagcacctatttgatagtcactggaaatccagagacaaacaacacagagccatgttctacagtatgtacagttttccaaaaagaatttctagtctttacttttttattacaaatggaatacgtatacttgcaaataattcagatactgtggaagagatcaaatgaattgcaaaagtgtccctcctcccttcaccactatctcccatggcatgcagagagagtaaccattatttgtgtgtccctccagaaatttttttattcaactactatttttttattttattaggtccgtcagttttccttttttgagcctctctatatcaaatgcaaataaatatattcagaacaaaccccactgtaaggttcacattaaaaaagacttgaagtcaccctatgaagacaaaaaataatcacattaagtgtgaaagaacctattcttccagtacaggataagccatacttactgggcatatattcatcttgaaaatctatactgatgttgtcttggggaattgaaaaggaactaggagtgttagttcctcggtattgacccacagttatgttatcaggtcacttgagttcaaagttttgtgttggcactagctaagtaaaggaaaacacctctgctttcattgttgagtttcacagaattgagagctgaaaggatcccaggcaggagcagctaatccaaactcccacaaagaacaaaaatcccccagaggatcttctgttcttatatttcctgcaatggcgtccctgtcatatcccacaatggcctccctgccatttggatatcccttccatatcctgttgaaattactccctaatagtaagctgaaatctgcccctctagttgtagtcttgggattatttcatttacatgatgaccttttaatatttgactagaattaaatcatctccccttggtctttccattcctgggctaactaccatcaatctgagggctaacaatacaagtagaaaaagtatacatttgtcactgatcactgatcaattattaatcaatgatcactgataactataaactcaaaaacaaaatcatgtggggattaagagaaatgtatcagttttatgttgtatttctggtccctgatactggctcaggtaatgccactattgtcaagaagataccacttgtaaagtagatttaattttcattatattttaccatatgcttctccattcatgacatctcttgagatgttgtggtttatactttcagtttttctccagtccatccgcaaatatcaggcatctactgtgttccaagatattaaagaaatcatcatgacttagcctcatcaacagcattgctagatctgggatggaaaggaagagtataatcctggcagtcaggaagaaggcagcataaagtataagtttctgcttccaaaaaaggtctctcatcagcctgtagggagtgtgtagggaagggacagctgtccttgtagtagggaagggttttattcaggtcgtctgggctccataatatcccttgtgtatctgcagtctcctttgccatggatcaacacaataggaaatcttccggcactgatggtttttccaagggggagttcttcctggagcaaagcaaatgaccaaccaggtttgaggacctgatttgtttgacaattccattttgtattgtaaattacttaattggcattctactcccaatccatcttgtcatttgcatacagtggttttgggattgagttcagctataccaaaagtctgaaccttctgcacttagaacaaggcaaccaccaagcttcacttgcactgaggccgtgtctccaatggaaatgaggcagctggcttgcaggagcttcccaactcagggaagtagaactcctgagtcacctccatatgcaaatgatttcacagtaatgctgttgaacttcacttcccatcacagcaaatgtgtggtaacatagcttccccacaggagtttactcaccatggtattttaaaggtgaaacatttcaaaactgaaatttgaaagaatttagttttggattcactcaattatcactatcacttcgggtgttattgcacctttcttgtttgtgagtttaaatgccagactctcaggccactaactttcaattaaaagtgtttttctttaatcgctgaacctaacagcagggaaaacgaaatgttcattcagactttcagaaccttcaatgagattaggcagctgaaagatcaaagtgttgcatagttgtcccgataaagctatttggatcatatggaccaaatcgactgctgtcattccccaccaaccccatctctccccaaaattcccagccctgtttaagtgttctctgtagcatttatctctatctagtatattgtgtagcatatcatatcatacttttctgttttgtttattgtctctctcctcctagaatataaactccacaagcacaaagatttgggcctgttttataatattgttgcatccccagggcctgatatacagcagagtggtggtacgaaaagagcacacaaaaaaatatttgttgagtcaatgaatgaatgatttcctcaaataggattagcctaaaattttggaaacatgaacagatttggatatgtgaaaatttatttccagactgttcatcaggaactgttagcagcttctaaagggtacactggagcagcagtagtaaaaggaggaagaggagcagctctgctactgctactatcgagtactactacaattagcacttgcttattctgtgtgttaggccctgtactgaacactctgtctaaattagttcatttcctcctggaaatgactctagggggtaagtgcttcatcatgtaagatgagtatttttcacattttgttgtgtctgaaatctgagtgtgtctttcaatgatggaatctttgattccatgataagtggtattattcccattttaaggatgaggaaactgaggtccaaagaaattaagtaatttgcccaaattcacccagcctagaaaatgataaagctagttctaaacccaagcagattagctctgaagtctgggcccttaataaccactttttattgcctatatttgtacctctggtgtacgtatcaagttatatgttgacttcaaaactatcatgaccttttcttggttttgattgtccaacattagtatagtgttctgggtctgcaaaaattttgattactcatctcatctgtaaaacattttgaactcgtgtgtttgtgcatgcacatttgtgtgtaattataaaaattttactttctgttaatatataagttgtatcataagaaactgccgtttttgaagagcaaaaaaaggttgaatgttaccagttacatctggttcaacctaatagacatttgtacaaaaacagacattttaagaggttgaaataaaaatttaataaacaatattttcagtttttactaattgtgatgcttcactatcattagctaatatgtcaaggcataatataccttagggtgaactttatcattaacaaaggtggatggtgtcaataatcttgaggtttgtgtttttttatataacactgcgaggtctaattaagtacttactgtttaccacctcatacagtggccgataaaaagtgtcacttctgctgtttcctctgggttgtgcttgaattattagtattatcttcagtcctcagtttctttgtgggaaactttttaattagttgtttaattttgtaagatggttagtttagtcaaaattagataagagaatttgaaaatccgtagctaccccaaagcaacctacacataagaactattatttttgtgttttgaaatcataattttattgatttccagtgtttccactggtagtggtttcattgatataggagtatcaaaacatcactcattatttatttcagtttcatttgatcctagccgttttgtattaactctctgtgaagaaattacctcacaaatctattgctgtccttggtaaaggaatggagaattaaggctctagatcattagtggttacactatagtattagaagtaaaaaaaagattataccaacaaaataagaacatgttaatgtacttgtaatgaataaacatgaataaagctcttatgctatataggtgcactaaacaatctactagaattgtcagcaaactacgtatcttaatcctgaaagggtcccaaaccaatgatctaaaattgaatcaaactttcttccttgagcataattacttaaatgatttattaaaatagccagcatttaaaagcttaaaatgtaaatatcataatgtggtatcctagatagcatcccagaacagaaaaaggatattagggaaaaactggaggaatggaataaattatgcagtttagttattaataatgtactaacgtccttagttatgacgattgtaccatggtaatgtaagatactaacaatagaggaaaccgggtaaggagtatacagtaactctatactatctttgcaacttttttgtaaatttaaaacttctaaaataaagaacaaatttaaacattaaaaagtatcaccaggaacatatatcactgtttacagatgaaatactatgtattttcatatctaatttctgatcattgacttcaaatcagaaaagtgaatgacacctcaaaatcaggttttctgtttactgaagtctaagaaaagaaagcataccagctggagagattcatgtttataaagacagatttataacaacaaaaataaaatatccaagaataaatttaagaagaagcactttactgagaaacatatgaaaacctgaacaaatggagagggatattttgtatttgaatagaaagacttctggtttaaagataattctctttaaattattttttgtagaaatttaaggggtacaagagcagtgttgtcacatggatatattacatagtggtgaagtctggggttttagtgtaaattaatctttacattttgtttgagcccaataaatgtaccaacatgatttttatagaaagatagtcattcctattaatccaaacttgtcccaactttgaattgaattgaggcagagctagcaggtgttccccacggctgaggcatctgaacattaagcatatccctctgagaaccagcctgcattgatactctttctaatgtggacagcatcaagctatgtacgtagttctgtgctcagcaaaagccctgacttctttttgtttatgtcctagccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataacactatgtttacaaaatatatcctaattcctcacctccattcatccaaaccatattgttacttaataaacattcagcagatatttatggaatataccttttgttccatgcattgtagtactcattggatacacatagaataataagactcagttcacactcttcaggaaacagataaaaaactaagaaacaaacaaaaaacaggcaatccaacaccatgtgggaaatgctttcatagccgggaaacctggggaatacctgagaggaatactcaattcaggccttgtttcaggaatccaaatcctggcacatcagagctgcttccctctttccagggtggcaggaaataaatggaacatatttttctatcttatgccaaacatgagggaccctttctccccggtgcctctcccaaggtagtctacaatatttcaactctagcagtctgcttagtgcatagaacatgaggctgtgtgtccctgggcaaattactagacttctgtgtgcttcactttccctgtaggattataatctactgagcaagcttattgtaagggtcagattagcaacagtgtatgaaaatgatttgagaccattgcctgcacaaattcaactatttttttttatctcactactctacagaagtaggtagggtgggagacagagtctgatgagaggctcagaatgtgaaagaaagtgaggcgagtgagcatgatatttaatataaacacaaagatattctgagaagagctgctcactgccccctcccccaatacatgttgataggaaaatgccacgtacttcagcaaaaacaactgaaaaattagatagaaaagtcaatcaataggaaaagataatccaggacggtgttgtgaacagaaagagggggaaaaaactttagaaaatgatggggatgctcttactggggtacgagtcctcaggtattgaactggctttcagtaaaagctagattagtgggttcctgccatttacaagctgttttatgacaacttacttgttgggtggcctacagtaactcacctaactgcactgagtctgtttcctcatctgtaaattggggatttttttttaaatacctggcatgcctaactcataaagttgttctgaaactgaaataaaacatacgtgaacaggcattgtaaactgtaagttacggaaaaagctggctgttgttgtgtctttaaagtttcacctgggtagtcaaagatggatcatgggtctcagtggagagctgagccaggcaggagctgactaagggtgagaggtgggagttagcagcctctgaacatctgtgtaccatgggaccccctttcctcctgcatggtaccccagacaaggagcctagtaagagatactaatggcttgttgtccagagatgttcaaactgcagagaaagataagacaacaagcattggcctccaatcatgatgacagataggaggaggtgggagctccttagcagtgctggttggccttccatgttctactgtgggccatctctgccatgtactgtaggctactagcttctatattaaagaatgcaagaggggccaggagcggaggctcatgcctgtaatctcagcactttgggaggccaaggtgggcagatcacttgaggtcaggagtttgtgaccagcctggccaacatggtgaaactctgcctttactaaaaatataaaaattagctgggtgtggtggtgtgcacctgtaatcccagctactcgggagactgaggcacaagaattgcttgaacctgggaggcggaagttgcagtgagcccagattgcgccactgcactccaccctgggcaacagagaaagactctgcctcaaaaaaaaaaaaaaaaagcaagaggaagtgaaataatcaaggccgccatttaatagtgagcagccactccatgtggtactgtgcaagcacattataaatattagcctcacaagaaatgtattagcatttgtattttgtacactggttaagtatcttgcccaagacctcaaaactggttaagggcagcagaatttagccccagcaccaccttttcaaagcctgggcttctcacacttctccatgctgttcccattttaacacaggtatctcgccattccagccactcaaactttggcatttaagaaaattatcctaaagctaaactaaacttcaaggatgaccattctcctgaccccttcccatcaaaattttatctttagtcagtttgttttcgttttgttttgtttttcagaactacctctggcacatcctccaaatgaaaggactcacttggtaattctgggagccatcttattatgccttggtgtagcactgacattcatcttccgtttaagaaaaggtagtatttccttaattgcagtggtctccactgggggtgaggaaggggtgagaattggatcatggctgcaaggaaacccgacttaacctctgcaaggtggtgcaaaggcattccactgttcaacagcaattatattgaagctgagtgggatcactgggtgaagatgaagcgtaaggggtgaggggcaggagaatgggtatggatggaggtagaagatgcagtgtcatacagtttttttctatcatgaaaataaccacagacttacagaagagaaagagctaaaatgcccgtcattttcagttgcattttagtcttgcattagttgcaaccagctggtttctgggtaccctaagtaataaaaatagttcctctgtagaactgtagtatgtttaccatagagtattttgcaaaatttttggtagaggatgttacataatttgcatgtgttcatttctccatttacctgtgggaacaattaaaatccaggaaaatgagtatattcaaataatttcctcccatttaagatgagtcagagtaaataattcctccaatacttagagaagtataccaagagatccagtgatggtatagagttgtctgatgttaaatagggaagtagaatatggaaggggattccaatagtcgttgaaaaattccccataaccccttacatgggggaaagtagtgttaactgagagagtagagataagctgtttccaaaaattatattcttaacaggactgagatagccagaatataaggatcaagtttcaatgacagtaagatcctgagatggagttgatttgcacaaagaaataattgttgccagcatgcattttgaatatttctctggaaaaaaagattagttggcagtagaaatggatagaaatcaatagatattaaaatacctcagaatttggttcatctctgggaaaagatgaaaaataaaagtgtatactcctcaagaacatctaggatcaaaagcatgtgccctacactattgaattaattaacctcataagttgggacctgtggaataaggatgtccaccagacttcctagggattacaaatgtttcacagaacttgaaatttaaacttgggtcactgtatgggatgtagagctgtgctatatggaaataaaaatgatttctttttctcaagggagaatgatggatgtgaaaaaatgtggcatccaagatacaaactcaaagaagcaaagtggtaagaatatcagaaggaattgggaagtaaaagtcaaaggaaacaaaaagctaaagcaataacaaagagaaatccatcagtcataatctcctctccttttaaagaatgctggttcccctttgcctcacagctaacacaagaactcctccaccgtctgaggaggtttaggagcagggaaggggaaggagtcagcttcatttgctaatcttctgttgccctgcaccctagcagctccttgcagcaggggacaaggatgacttaggtggatggataattaattgattctaaaatattgtgtgtcagtattgtaatactatgttaattgcaccatgcacggtatctcatttaatcccccaccccttgccattaccaaagagagagagagagagagagagagaaatactagaatttatcctcattttacagtagagaaaacagagggtcaagaagataatgtaaagtgcccaagaacacacagctgatcacaaaaatcaagcttgggggccattagcctaaccacagacccttactcttaacccatctgcttcaatccattttgctacaaatgtttacatttataagcagggcagaaaaacctcatccaggttattgaactaagaagaaagttatattaaggtttctaatttttttaatgtagttagaaaccaaacttaacaatgagcccaagtttaaagcagtctaattaacctggacaagctcaggcaagtttcattctgtggcccatagcatcatctgtgttgtaaagctaagtagcaaatgttgtttgggtcatgctgggggacaagccatcccaatttgctcaggactgaggggttttccaggatatcatgtaaggataattgggtacaaatataacctgctgctttctctcatttcaaatttatcatttatcatatcagcaactatgagttatgttttttattagatttcttgttactttttccccagaccacttcccatgaaattaatatactattatcactctccagatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagtt

SEQ ID NO: 373 - DNA, 25792 bp, Homo sapiens
  Enhancer and CTCF Binding Site Downstream from the Coding Region of CD274
tacttggaatatttgcagccttgttcctagttcttttttcattgcttatacagcatgtttttatacagcatgcttttgaatcctgcacaatgaaaaaagtatcaaaagattttattttaaaaaagaatgtattgaaaattttcattctctctcattcggcagcttcctttaggaccataccaagaagagtcaaaatcctgtcatctacattgaagatctaagggagagagggtgggagagaaggagtggaacccaatagaactatagggaaacaaagggacttacctctaagaaagtacttttcccagatctgtaaacgggtatgcaatccagtgtgtaggaagatagatgtattgcagtcttcaagttttgaaaataaagcgaggaaactagaactaagccaagttgaggattaagggctagcaatggttaggaccatagatctgtggttttaaacaagcatgacaaaacttatcattcaaggaagtatagaccttttaatgtgtcatccggtgagattttagtcatgaaattccattttaaaagactatcacttatttgaatcagatactcttaaaggattataatggctatttctaagaatatgtgtttgactctagatgcttttgtttgtttgtttttgagacagagttttgctcttgtcacccaggctggagtgcaatggcactatctcagctcactgcaacctccgcctccaggttcaactgattctcctgcctcagcccctcgagtagctgggattacaggcacctgccaccactcctggctaatttttgtacttttagtagagacagggtttcacaatgttggccaggctgatctcgaactcctgacctcaggtgatccacccatctcagcctcccaaagggctgggattacaggtgtgagccacggtgcctggcctctggatgttttcagtagtaatgatgatgcactatttatgctagcccttgggcagtcaaagcaataaaaatgtgtgctagacatcaagatatctggccttcctaatcaggaaaggatatggagaactagtcttcctggcttgccttggtggtatggaaattttgtgacacttgaggggtctgtattatagaaaagttaatatgaaaatggttcataagctttcattaaacttttgttctagtcccttttacaagtgtgtgcctgtctgccacaagtaggcctaatatattttttaagttttatttttaattgacatataattgacttttttttattattatactttaagttctagggtacatgtgcacaaaatgtaggtttgttacatatgtatacatgtgccatgttggtgtgctgcacccattaactcgtcatttacattaggtacatctcctaatactatccctccctcctccccgtaccccacgacaggccccggtgtgtgatgttccccatcctgtgtccaagtgttctcattgttcatttcccacctatgagtgagaacatgcggtgtttggttttttgtccttgcaatagtttgctgagaatggtttccagcttcatccacgtccctacaaaggacatgaactcatccttttctatggctgcatagtattccatggggtatatgtgccacattttcttactccagtctatcattggtggacatttgggttggttccaagtctttgctattgtgaatagtgctgcaataaacatacatgtgcatgtgtctttatagcagcatgatttataatcctttgggtatatacccagtaatgggatggctgggtcaaatggtatttctagttctagatccctgaggaattgccacactgtcttccacaatggttgaactagtttacactcccaccaacagtgtaaaagcgttcctatttctccacatcctctccagcacctgttgtttcctgactttttaatgatcgccattctaactggtgtgagatggtatctcattgtggttttgatttgtatttctctgatggccagtgatggtgagctttttttcatgtgtctgttggctgcataaatgtcttcttttgagaagtgtctgttcatatccttcacccactttttgatggggttgtttgattttttcttgtagatttgtttaagttctttgtagattctggatattagccctttgtcagatgggtagattgtaaaaatgttctcccattctgtaggttgcctgttcactctgatggtagtttcttttgctgtgcagaagctctttagtttaattagatcccatttgtcaattttggcttttgttgccattgcttccagtgttttagtcatgaagtccttgcccatgcctatgtcctgaatggtattgcttaggttttcttctagggtatttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtggatgtgtggtattatttctgagggctctgttctgttccattggtctagatctctgtttcagtaccagtaccatgctgttgtggttactgtagccctatagtatagtttgaagtcaggtagcgtgatgcctccagcttttttcttttggcttaggattgtcttggcaatgcaggctcttttttgattccatatgaactttaaagtagttttttccaattctgtgaagaaagtcattggtaacttgatggggatggcattgaatctataaattaccttgggcagtagggccatttcacgatattgattcttcctatccatgagcatggaatgttcttccttcggtttgtgtcctcttttatttcattgagcagtggtttgtagttctccttgaagaggtccttcacatcccttataagatggattcctaggtattttattctctttgaagcaattgtgaatgggagttcactcatgatttggctctgtgtttgtctgttgttggtgtataggaacgcttgtgatttttgcacattgattttgtatcctgagactttgctgaagttgcttatcagcttaaggagattttgcgctgagacgatggggatttctaaatacacaatcatgtcatctgcaaacagggacaatttgacttcctcttttcctaactgaataccctttatttctttctcttgtctgactgccctggccagaacttccaacactgtgttgaataggagtggtgagagaggacatccctgtcttgtgccagttttccaagggaattcttccagtttttgcccattcagtatgatattggctgtggatttgtcataactagctcttattattttgagatacgtcccatcaatacctagtttattgagagtttttagcatgaagcgctgttgaattttgtcgaaggccttttctgcatctattgagataaacatatagtttttgtctttggttctgtttatatgatggattacgtttattgatttgcgttacgttgaaccagccttgcatcccagggatgaagccaacttcatggtggtggataagctttttgatgtgctgctggattcagtttgccagtattttactgaggatttttgcatcgacgttcatcagggatattggtctaaaattctctttttttgttgtgtctctgccaggctttggtatcaggatgatgctggccttataaaatgagtcagggaggattccctctttttctattgattagcatagtttcagaaggaatggtaccagctcctctttgtacctctggtagaattcagctgtgaatccatcttgtcctggactttttttggttggtaggctattaattattgcctcaatttcagagcatgttattggtctattcagagattcaaattcttcctggtttagtcttgggagggtgtatgtgtccaggaatttatccatttcttctagattttctagtttatttacgtagaggtatttatattattctctgatagtagtttgtatttctgtgggatcagtagtgatatcccctttatcattttttattgcatctatttgatttttctctcttttcttctttattagtcttgctagcggtctatcaattttgttgatcttttcaaaaaaccagctcctggattcattgattttttgaagggtttttcatggctctatctcctccagttctgctctgatcttagttatttcttgccttctgctagcttttgaatgtgtttgctcttgcttctctagttcttttaattgtgaggttaaggtgtcaattttagatctttcctggtttctcttgtgggcatttagtgctctaaatttccctctccacactgctttaaatgtgtcccagagattctggtatgttgtgtctttgttctcgttggtttcaaagaacatctttatttctgccttcattttgttatgtacccagtagtcattcaggagcaggttgttcagtgtttagtttccatgtagttgagcagttttgagtgagtttcttaatcctgagttctagtttgattgcactgtggtctgagagacagtttgttataatttctgttcttttacatttgctgaggagtgctttacttccaacaatgtggtcagttttggagtaagtgtgatgtggtgctgagaagaatgtatattctgttgatttgtggggagagttctgtagatgtctattacatccacttggtgcagagctgagttcaagtcctggatattcttgttaactttctgtctcattgatctgttaatgttgacagtggggtgttaaagtctcccattattattgtgtgggagtctaagtctctttgtaggtctctaaggacttgctttatgaatctgggtgctcctgtactaggtgcatatatatttaggatagttagctcttcttgttgaattgatccctttaccattacataatggccttctttgtctcttttgatctttgttggtttaaagtctgttttatcagagactaggattgcaacccctgcttttctttgttttccatttgcttggtagatcttcctccatccctttattttgagcctatgtgtgtctctgcacgtgagatgggtctcctgaatacagcacactgatgggtcatgaccctttatccaatttgctagtctgtgtcttttaattggatcatttagcccatttacatttaaggttactattgttatgtgtgaatttgatcctgtcattatgatgttagctggttattttgcgcattagttgatgcagtttcttcctagcattgatggtctttacaatttggcatgtttttgcagtggctggtactggttgttcctttccatgtttagtgcttccttcaggagctcttgtaatgcaggcctggtggtgacaaaatctctcagcatttgcttgtctataaaggattttatttctctttcacttatgaagcttagtttggctggatatgaaattctgggttgaaaattcttttctttaggaatgttgaatattggcccccactctcttctggcttgtagagtttctgctgagagatccgctgttagtctgatgggcttccctttgtgggtaactcgacctttctctctggctgcccttaacattttttccttcatttcaattttggtgaatttgaaaattatgtgtcttggagttgctcttctcaagaagtatctttgtggtgttctctgtatttcctgaatttgaatgttggcctgccttgctaggttggggaagttctcctggataatatcctgaagagtgttttccaacttggttccattctcaccatcactttcaggtacaccagtaagacgtagatttggtcttttcacatagtcccatatttctgggaggttttgttcatttcattttactcttttttctctaaacttctcttcttgcttcatttcattcatttgatcttcaatcactgataccctttcttccagttgatcgaattggctattgaagcttgtgcatgtgtcacatagttctcatgccatgtgttttcagcttcatccagtcatttaaggtcttctctatgctgtttattatagttagccatttgtctaatcttttttcaaggtttttagcttgtttgcgatgggttcaaacatcctcctttagctcagagaagtttgttattaccagtagtctgaagccttcttctgtcaactcgtcaaagtcattctccgtccagctttgttccatttctggtgaggagctgcgttcctttggagaagaaaaggtgctctgatttttagaattttcagcttttctgctatagtttctccccatctttgtggttttatctacctttggtctttgatgatggtgatgtacagatggggttttggtgtggatgtcctttctgtttgttagttttccttctgacagtcagcaccctcagctgcaggtctgatggagtttgctggaggtccactccagatcctatttgcctgtgtttcaccagtggaggcttcagaacagcaaatattgtagaacagcagatgctgctgcctgatccttcctctggaagcttcatctcagaggggcacccggctgtatgaggtgtcagtcggcccctactgggaggtgcctcccagttaggctactcaggggacaggaacccacttgaggaggcagtctgtccgttctcagatctcaaactccgtgctgggagaaacactactctcttcaaagctgtcagtcagacagagacatttaagtctgcagaagtttctgctgccttttgttcagctatgccctgtcccaagaagtggagtctaaagaggcaggcaggcctcgttgagctgcagtgggctccacgcagttcgagcttccgtgtcgctttgtttacctactcaagcctcagcaatgacgggcacccctcccccagcctccctaccaccttgcagttggatctcagactgctgtgctagcagtgagtgaggctccatgggcatgggaccctccgagccaggcgcgggatacaatctcctggtgtgctgtttgctaaaaaccattggaaaagtgcagtattagggcgggagtgtcccggttttccaggtactgtctgtaatggcttcccttggctaggaaagggaattccccgaccccttgcacttcctgggtgaggcaatgccctgccatgcttcggcgcaccctccatgggctgcacccactgtctgtcaagccccagtgaaatgaacccagtacctcagttggaaatgcagaaatcacccatcttctgcgtcactcacactgggagctatagactggagctgttcctatttggccatcttggaatctccctacccattttccataattgacatatttatagggtacagtgtaatgttttgatagaagtatacattgtgtaattatcaaatcagggtaattagcatattcttttcctcaaatatttatcatttatttgtgataagaacattcaaaatattctctcctagttattttgagttatacagtataatactgttaaccacagtcaccctatgtattagtccattttcacagtgttataaaaatactacctgagactaggtaatttataaaggaaagaagtttaattgactcaaagttctgtatggttggggaggcctcaggaaactcacaatcatggtggaaggggaagcagtcaccttcctcacaaggcagtaagaggagagagagcaaagagggaagagccctttatgaaactatcagctcttatgagaattaactcactatcatgagaacaggatgggggaaaccacccccatgatacaatcacctccctccctcaacacgtggggattacaagtttctcccatgacatgtggggatcacaattcgagatgagatttgtgtgaggacagagccaaactgtatcaccctactatgcaatagaacaccagaacttattccttctatctaactataagtttgtacctgttgaccgatctctactaatctcccctcctcatgcccccaaccctctccagcctctggtaaccactaccctactttctacttctgtgatatcaaccttttaacattccacatatgagtgagatcatttagtatttgtgtttctttgcctggctatttcacttaacataattatcctctagttttatccatgttgccacaaatgacaggatttcatttgttatggctgaatactattctattttgtgtgtgtgtgtgtgtgtgtgtgtgtgtgtgtgtgtgtgtgtgtacaccacattttttctttcttttttttttttaaagagatggagtcttgctatgttgcctaggctggccttgaactcctatcgtcccacccacagcctccagagtagctgggaatataggcacatgccactgcacctggcttatataccaccttttcctcatccattcatctgttgatggacacttaagttgattccatagcttcactattgtgaatagtgctgcaataaacctagcagtgtagatgtctatttatgtctttatttatttaactattttatttatttattctttatttaactattttaaagctgagaaattcaaaattaacttttgttctattgatatatttggccaaatttgttaagacagatacacctgtttttagaatttttcctatcccaggcttccaaagtttcaagaaaattgatataataaaccaacttattcccattataatttaaacatttccgaaattatttccattttaaaagaagttaatgtttgaccaatgaagcaattgtcaatgatggggttttattatgagtttaataatgatatttaccatttattgagcatgtaccttatgcaaggtcttcatctgtcaatcatctcttctttctgcaaatacaagacttagcaagcttggagtaagttatgaatgctaacatatgtgagatcaaatagtctctttctagggcactgaaggtctttggggacttaaaaactcgattacaatgattcagtcatataagagaaaattgcaacacacacacacacataaaacagaaaagaactatttgtacatgccaggaaacactgctctaagagttgctttattctaggtgactatgaaaggaaaaaaaaaatctaactatagagaagttaaaaaatgtacatatatttgggaagaataggaaatttcaccaaaggcctggagtcactcaaacccgagttccaatcttcttagatgtaaattaacttcattgaaccagtttactttaaaaattcttgtttttattaaaaatttcaattactattaaaattatatttttaattaaaaatactttaaaaattaaagtgtatagtttttctatttatcttaaatattcaaataattgtgaattaaagttgtgccagcttgaagatttaaagtgataggcttaataattttggaacttttcttaatgtcaaagttaactagagcttcttttctttttcaaattacacatttaaaattccggcatcagttcctttttgagtcatctaggtctctcacgtcagtaaatattgagctactgtaaagctgaagttacttacgtagtaacataacttacttaggggagatttgtaaatgtttattttggataagctatgtcttatttttgttttgcttttgagaaagatacttctcattctttgctaatttcaaacaaacagctttatagtagaaagcaattatttctataactcaagttaaataattctgtctattctttagtcaaattgaaaataagacataacaaaacaatgacccccttgccttggtttctaacttttcagaggtgaacacaaccataaatggtaactaacttacagtagtgcctactgtatccactaagcattatgtagaatacagaggtgacccagacatgcaccctgcccttaaaaaacatgaagattgaaacatattatcatgatttacaggcatagctcctcctcctccaaaaacaaaacaatacaaaacacacaaataactgtgtttgtcagaaatacagacaccaagtgttaaaatgtcagaaaatagggcagcttgaactcaacctttgcactctctagcacttgaattatattttatcaaacctttgttaagttagttcatgtattttggtgcctcagtggttctaatccaagtatagtatttttgtagatccatctgtcccagtgctgcataacagcactagaacatgtggaagagatttaacaaatagtattagctatgatatgtatatattagtatatattacatgtcaggaagtgttctgagttctttacgtgtactaattcatttagccttcccaataaccctatgcggaaagttattaccatcttctcttgacagataaagaaaccaagccacagaaagtttaggtaacttggccgaagtcatgctactaataagttatggccccaggatgtgagcacagtttgacttcacagtttgctcttataccctacactatgctacccctaaataattattcgagtcatgttaatgaggggattttaaaaacttgacagtattggaacagtatatatagtaagctgatacttccctgggttggacaactccagaagcaatctgatgtttgtttgcctgtatatttttgtttttctaggcaatgggggctaatctcactagtacttctgtagactgtctagcatatgtctttcggtgaatctttgaactcgttttccatttggtatatatctgatggtacaattgctgaattcttggtatatacataagaatagaatttctaggtcatggtataggattgctggaaactgtaccaatttgcattcccaccagcagggcataggagttccagttgccttgcatttttcccaatattttctgcctctttcattttaggtgactatgcagagacatcacattttggttttaatttgcatgactctgatgactaatggagtcaaactcattttcatatatttattggccatttgtcaataaagttttatgaggtgtcttttcaagtgatttgcccattttttaaattaggttttctgcctaattcctaattgtgtaggaattcttagcgtattctagatacaagcccttcgtcagagacataaactgaaaatctcttctcccattctgcaggatgtctgttctctcttcacggagtcttttgaggaagtgaagttcttactttacatagttcaatttaccaatttttttcctcatggctagcacttttttgtgtcctgtgtaagcaaactttgcctactccaaggtcatgaagatttcttccatgttttcttctaaatctctatcattttatttttcacatttagatctgtaatccttctggaattatttttttgcatatggtgtgagataggagttaaaatacattttcatgtggacattcaattgtccctacaccatttactgaaaataccatcctttcccccactatactgcagtgtcacctttctcataaactagttgactatatctatacctatgtctctatctatgtctatctacctacctgtatatatctgtttatggagtctgttctattacattgatcagctcatttgttttttttttttgtctagaaaattttgctaaagcagtattaatgagtttgaatcttgcctcttggggctgtgacaacacttcaggttgtgattcctcacctgcagccctatccatgccatggcaaccaccgaggcatccatcctgtggttatctatacaatgcataataaagacctcagctggcctcggcggctcacgcctgtaatcccagcactttgggaggccaaggcaggcagatcacgtgagcacaggagttcgagactagcctgagtaacacggcaaaaccccatctctccaaaaaataaaaaaattagctgagcatggtggcatgcgcctgtaatcccagccactcaggaagcagaggtgggaggatttcttgagcctgggctatcgaggttgcagtgagccgagatcgcgccactgcactccagcctcgatgacagagtgagactctgtcggaaaaaaaaaaaaaaaagataacctctatctcccactgctttcccttcccaccgtcaccccaagtttctgtcatttctttgaatttgttatttgactttccacaagtataaaagtacacttgtatcatttattttaggtattggatatcttcccttccttatgtattattttaaaagcagctaaataaaaaatttagcttggtttttgttgttgttgttgttgttttgtttttttggttttttgagacggagtctcgctccattgcccaggctggagttcagtgacatgatctcagctcactgcaacctctgcctcacaggttcaagagattctcctgcctcagccttctgagtagctgggactacaggtgcatgccaccacgcttggctaatttttttttttttgtatttttagtagagacggggtttaatgtagccttcaaataatttttttaactataaattcagtggcttttgatttttcaaaaagagtctccactcttacctaaaactacaatgggtatttgaattctagaaggaggtgattttattccaaactgataatcactataaaacattatgtcttttctactggaaatagaaatacagtgtatatagatgtttgttagacatctctaataaaaaaatgagtattgtatataactgagccttcctagaatgtttgcccacagccacagtgttatagcagttcatattatctctctcatggtcacatgttagaagtagagtcatgtagcagtatgcaagcaaatcccctgttgggatgcctgttggcttcagattagctcacttactgggcaaaacagagactatgggcaatgcccaacatttcctcatttctcataatggcttatcaaattcccagtcacaagagctaaaaccttagaacaatcttttactcttccctcttccccatggcacagctttaacatcgactgaagcttcttttatagaattgtttctccggttccttttttgtgaatttattgttactattctctctcaaacttcatataggatgttgacagtgacttaagcaataagaaagattatcacataaaacaaaacaaaacaaacaaacaacagcaacaacaacaaaaaatatatatatacacacacacaggtaggatggccctgtccctgcttctctgcgatcctctttgttctaccctactggtggatctatacccaaactggcagcaagatagcttggcagttccaggttacacctagcagaccacatctcatgtctcactggccagagtcaggtcacatacccatctttaagacagttgttggcaaggatttaccctggagccagggatgaaaccatcttcccctgagtcacatgggaaaggacacctgaacaaaattagcgtcttgtcaccatagggaatgggctctgaatgctggtggataatcaacagtgtcagctccagactctaaccacttcacttagataactgcagccacctcttaactgtggtccctgcctccagtttttggctccatcttctcaacatgtataatgaagccagtacaattctccttaaacacactgctgtcatgacagcactttcttggtcagggggcctaggtggcttcactgtgactgatggacaaaattcgaacaccttggcctccccattcaagatgtccacaaccagactccaacctatcccttatccttccttctccctagttccttacaacaggggtggtagtaaatatatcaggctttgtggaccatgtggtctctgtcacaattacagtaatattcccctcatctgtacagtagaataagttgttctgagaagaagaaggagaaagagagagagaccacattcataccacctttattacagtacgttgttataattgtcctttttttttttttttttttaactcttgtcttgctatgttgcccaagctggtcttgaactcctgggctcaagtaatccacacacctcggcctcccaaagggctggaattacaggcacgagccactgcacctggcccgaattgttctattttattagtagtaattgttgttaatctcttactgtgcctaatgtataaactttatcttttctttgcttatctgtctttccacaagtataaaagtatacttttaccatttattttatgtattggatatctctctaaacaaatcacaggtatgtatgcataggaaaaaacacagtatgtgtagggtttggtactatgcacagtttcaggcattcacttggggatcttggaacataacccctgcagataaggaggggactactgtagtcaattcttcccttgtagtgcaaaagcagccatgcacaatacaatacaaatgaatgtgactgtattccaataaaactttatttacgaaacaggcagtaaactaaatttggcccacaggacacactttaacaatccctgccttacatgaaatcccttactccactaggccctaagttggtaaaatcaacactccattggagccacaaagatgacaacataatggtatggggaagtcctacctacacaggacatctggcagggtccgggcttcatgtctgacatatcgtcaagagttacattggcaatgagactagttttcgtaaatttattcagtttgatcattcagctgattcaaagatcaaaagatcctttagggctgtgttttctgacctttttaaggctgtggtacatggatttgttaggctaactgagacaaataaatgagtttgtctcttcactatgctgataataccttggcaagtcatcagtcaagctctttttctcacccttacccccagatctacaccctgctcctacaatcttatctctgtctccttctcccttctaaaagaaacctgatgaaacaaaaagaagaaacccagagataataatacacccaagatcatactgatagacctacatgtgccaaacattggttgagaaataatgtcttgtgatccacaataatcagtaccaaaaatccaagtacttcacgcggtcttaggaaacaaatatgtgggaaaggctgaggcttggcttatttagttagcttttgttttagaactacataaacagagagtgtaaatagtaacctgattaaaaatacggactttagggttagtttatctgggtttgaattctggttctgctgcttcctgtttatctgacctttggtaagtgacttaacttctttgtgtctctatttcttcatctacgtatctgacccagagagttgttaggataattatgtgaattaatatgtgcaaaaatttaaaaatagggcctatcacattgttaacagcatatatgagttggtaaaaggatatatatatatgttgcgtcttaggcatggagtaaaattcatgtaaacaaaaaaacagagtgaatattcacttaggcaggcagtctgctccatgtaatcattcaaggattcagatagacaacggctctgccatcttcaacatgtggtcttcaaattttccctggaggtctccatacagttaaatagactagaagggcatacagaatctcagtgggagatttttatgcgctagatttaggaatgatgcgcataatttcctttcacattccattagttagaatttagtcacatgaccataacctaatcccaagggagactggaaaatgtagggtagcttcccaggaggaagaggagtatatagatttgatggaagacctatcagaattggttataactgagtatctggacaacaccatattggtactggtatcctagcaagaaaagtgtacattgaattgtagtatctatagtgccattagcctttcatgaagttattttaataaaacaacttttttgaaactagttattaaatacggtctaaaaataatgatgaggaactctttatttcattacctagtgtgctttctaaagaacactaggaaaaatttccctttgaccttaatacaaacacacaaacacaaaatagttgtgtttccccgagtgaaaagttgcttagctttgcccctgctccccaaatcttggaaatattattaattgtttaactgtccaagcttggcttagaaagcttagaatcaattttattctttcactcaactaatttactgagcatttactacatgtcaaacttcaagctagacactgaggattcaagagggaacaagacagacatggttcttgccctcatggaattcacattctaataaggggtcaaggaagtggatgtgtggaaacatataacgaataaacaaatgactatataaatgcagcaataccaatcaataagggaccaagctaaataattgccaaattgggaaccaattttaaatgggatggctgggacaggggcttcttcaaaaaggttgaatttaaaccgagccagccatacaaaagggcgtacccccagcaggaggcacaatgtgcacaggagctttgatgagagattgagttaaggagttcaagggctagaaaggaggccagggtgactagagagtggagagcagagcagggaggggcacaagatgagactgtgcatcacgcaggcccgtgacagccatggtgaagagtccaaattctgttctaaatgcggtgggaagtggttgcaagtttttgtttgtttgtttttgtttttgttttgagacagagtctcgctctgtcaccaggctggagtgtagtggtgcaatctcggctcactgcaacatctgcccctcgagttcaagcgattctcctgcctcagcctcccaagtggctggcactccaggtgcactccaccacgcccagctaatttttgtatttttagtagagatggggtttcaccatgctggccaggatggtttcgatctcttgaccttgtgatccacccgcctcggcctcccaaagtgctgggattacaggcgtgagccaccgtgcccggtcagttgcaagttttaagtagggggaaatgattgatccagcttgtgttatgagatcatttgggctgcagtgtggaggaagaactaaaaggacatggaagcaggaggacagccaggtgatgggtgtcgtaagcctgggaaatgtgatggtaatacaagcatgtcaagcccgcagatcctgacagtaagcatgccttcctgacttgtgcccggggagaggaggcgacagtgattctgacctcttcttatttccctccctttctagcgccactttcctgagcttttttactgtatgttatgtataccgtatgctgtatgctgtatgctgtatgctgtatctaacagcccttgtaaacagccttaaatcctttctaaacatcctggatagtcctagaatcctagaatatggattctttcttggtttcaaaactgatttcattatattgcatggaaagaagaaatgtctttattgtagagtgttggtatttctgggtaggttgattcaaagattaagttgtgagggcagttgggacttttagagaaagtggatctagaaaatctaaattgttactaagaaatattgatgaatgtaggtcatggagctcagaaagaagtatctctttgatatttttcctaaactatgtgaaagggaagcaatgggaaatttcgtgaacggagtcaggaaagcctcaagttgggtggctaggaagggtagaggagttgctattagggaaccgaggagtgaatgtggagatggtgaagtgagacaggaggctgcttcctcaaaagtcaggacagttatgagaatgctctggtttgaatgtcaagatgttactggaaatgaataactacaaatacacgcatgttcatgcacacacacatacacaaacacatgaagctattgaaaagaatatgcagcaaatgtgttttgtaagtgagctagtatctagttgaagtaccatgatcatctttaaaatctcttgctagaagaggaatgttgactgcccagtgtgggtgtggatagggaatgaatatcctcgctgtggtatccataattgaaatgcactgtgcctcatctccagaccagcccttacagcagtgccaatctccttcttgtccactgcacaatagctcgctgactctgcctactctttggtcagtttcccggatatccttgtctcttcattcttagtacatcacatcattactcaggcctcttgcctgggcccctggcagctttaggtacctcattcagcgcaactgttttcctgttttcttgagcagtgaggtcataatttcatgaccttggatacacattgcgtgaagtaaaatgtttattaagtcagatgaattaataacattttcaggaagttcataattgatggagacaaattacatatgtaccatacatcaacacacacacacacagaatgtgcacactcaggagagattaatagtgtgtatgtttattagatataaagcagctgtagcctatgaagaaaggacagaagaaacagcgaggtacaggaactagagtcgacaaagaagaaaagcaaagatgcccacatacatcctacttttaatgcaaagcttgtctctgctggataacatcacaaatcccccaactaaaatcaccaattgttctgtccctaaagatatctttctagttctcaatcccaggccaggtggggctctatttaactctcttttatttaatccacttttgatcactcttaggaagtttcactttactcaacaagctcaagattgatcacccttgactttatctgtttatcttaggagtgtttggttgaagacagaaccacagatgcccattattactagtattatcataacaataaagaggagcaatagtaaataaaggaaacccagagccagattatcgggacttaaatctgttttcccacttttgtgatgtttgaccttcagcaaattatctaccttctctatgcctccgtttccctattcataaaatggaaacaatgaaagtacctacctcgtagggtttttgtgagagttaaatgggttcatacacataaagtacttggatctgccctggcaatatttagacctctgtgaatagtaacctgtattactgcgtttcagttaggaatgactaaatgttgcggcaaactgcacattctgttgacccttcctggtcactgctcacccatccgaagcctgtgtaatacaatattcaactctgaaactgcatctaaggtggccaggaaggaaagctggagggaaatgtgtagaccagctgacctctattttaggttgaaggtccaggcatttcctcccctttctctacctgtgagaggagccaaccagagctggccaagccatgatgcagcccctcgtgtggccatttccttcccagcctctattcatcttttaccactctctagcagcagaagctggtgggttgtggttaccactcttgtttgttgccccacatcccagcttcattttctcaggatcactgccaggcaataaggaaagtttggggcctgaaaaaatctgccccaggcctgtgtagagcaaaatacccttggacattatacccgcagaaggttcctcaaaattatgtgacatttttcagctgatcgaacttccctaacctgacttcctggaaaagccaagaattcagagaaaatgtagggcactgacgaaccaatgaagaggtcagtaaattctcccggagtccccactcaggtctgaaaaatgttgtgtgaaacctgtgggtagggatagcctccaaatatttgccctcccacaactgtccataggcctagttgccctgccatagctaggtcccaaattgttgcaaaagccataaagccatatccatgtagattctgccaaaccagctaactggccaatctgttttcccacaacatgagttaccttactgggatgtgcgtcttcaggtatatgcacttggatccagttacagcaagttaccccaaggaaataatcagacaagggcatagagctgattgtgaagggtcattcatggtgcccatggttttgtaatatcaacacttacaaattagaagcaacctaaattgccatcactaggggatggcttaaacaaactatggcatacccatacaataaaatatttatcagtctttataaataatcatggggtctgtaattaccaacatggaaaaatgcccatgatacccttgaaaagtgataaaacagttcacggaattacattctgatataatggtacttattaaaattgcattctccagcctgggcgacagagcgagactccgtctcaaaaaaaaaaaaaaaaattgcattcatcaatgagaacacttggacacaggaagggggacatcacacactggggcctgtcgtggggtggggggaggggggaggggtagcattaggagatatacctaatgtaaatgacgagttaatgggtgcagcacacctacatggcacatgtatacatacgtaacaaacctgcacgttgtgcacatgcaccctggaacttaaagtataataataataattaattaattaattaaattgcattcatatgaatggtacctattaaaattgcattgatatgcaattttaataagtaccattatatcagaatgtgtccagggatctacagaaaattatgttcacaaaaatactgacagcaattatctctgtggttgagtatttgggtaatatttactgttattttttacttttttttggtatttagaaaacacttagcaatgatacaatgtgctatctgaaaaaaactaaactttttaaaatataagtttgaggggaaaatgaactaagttagtaatgttttgggaataagatcatgggttggccacaccaagcaggtaatggcacaaggataagataattaacatttattaagcacttattacatgccagcaggccctgttctaagcactttccgtgtatcaactcatttcatttgcacaactccacaaagcaagtcttttatggtgcccattttacagataatgaaatgaaacaggcaccaagagaggaagccgtttgtttgaagtcttacggctggcaggaggtgaaacagagatttagacagaggtctgcttccaaaatctctgagcgtgacccctgtgctcccctgcatagggctggctttcctgcaggggaggagggaaggtgctgaggtcagaggaggagagaggaatgatggagggagtggagagggcagaggtggctgctgacgatggggaacaagacactgtcctcttccccctgcagttcctgaaggatcttcattctcccactggccacctgtttacctaacccctctaaagcctcagtttcctcttttgtaaagtgagggagccttctcaggccattcaccttaattagttcctctctatgccatataaagtcctagaagccagttctgctgtggcacatatgcagccaccaccatcatcaccagcatcccacttccggctgagagacgcaggccccggtgtctcccagtgtgcaagttgtcagagcaggctggaagagaattgggcattctctgtctctgctgtagaatgaccaccctgaaggataattctgctcacttgttattctcctcactggacaggagaccctggaagcagagacaatatctgatgcacctctgcattcccactacctggaacataaagtcgttcaataaataaacatcctctgttgaatgaataactggaaagtacagccatgtggccttatgattccagagtaacaagtaggaaaagcaacacttgcatattaatttctttattttttgtttctgttttctaccttatctggcacagagttcagagtaggtacagtcattaaagaagtcactgatttttaacatgccacttaagcaaaaggagcaagaaggccctatttatgttgatcaactaattcaagaaattctgggcttttgttttttcttttcttttttctttttctttttctttttttttttttttttttttgagacagggtttcactcctgttgcccaggctggagtgcaatggtgcgatcttggctcactgcagcctaccaggctcaagaaattctcctgcctcagcctgccgagtagctggggctacaggcacatgccactgcacccagctaatttttgtattttttgtagagatagggtttcaccatgctgcccaggctggtcttgaattcctgagctcaaatgatctacccaccttggccatccaaagtgctgggattacaggtgtgagccaccacacccagccaaattctaggctttctatgtaaattataaaatgtaatttacaaaactctgttcagacattttatcaccaaggcagagagtggtcaaatcacagagctagtaaggagtagaaccaaatccagcttctctgcccttggtgtcaactgctttttctactttccacatagctccacccctccagccagtcacaatggtttctaaaagtggacctgcctttgcagttattcattcaacagaggatgtttatttattgagcaactttatgtttcaggtagtgggaatgcagaggtgcaccagatattgtctctgcttccagggtctcctgtccagtgaggagaacaacaagtgagcagaattatccctcaaggtggtctttctaagcagagacctgccttaattctgttgccttaggtgagatcaacttacttctgcatgcttccatttctcctcccccttggtagattgagaatcatggtatcagctcttcttagtgaaagaaaatctaagaaacatagacaggtgtccacatcttgaagtagctgaagtttgtctttgggttctcagcttccttttctccctcttgcttacttcccttcaaggattgctgccatcagtgtcatcaaacccagggattccctaatgctaatccaccaattagagcacggctggttactacagaaccactgatgagtttcaaaaaatgcagacttctggaccccacccttggagattttgaatcaggaggtcttaggtagtgcccaggcacctctatgtttcaggttccccaggggattctaacctgcagccatattggggaaccactgacctaacacgaaaacatgagtcagctgtctcaactgtattgaaagtgatgaatcatcatttcactttaaaaagaaaaaaatatgagctgaaaccaaagtcattgtgagaacctttcatttcctttacctgagtttgaattcaggtttcctttacttgagtttgagtttagaagtcttctatacttggtccaagcatttttacggagattcccaaggtcttaaggcaaacagacttaagacctgtcctcagtttagtcctgggaacatgctgtaaccctgatcagccctggctagggggaccctgggaaactggctggctctggagatccttcaggccagagttgctgggaaccacaccgggttcatcttacaccatgcctaggtgctggggtccaatagtcttgtctcctctggcttcccagagccagaactaggaagacgagaaggctttgggatatggctggcttccagagactgaatcagcaactcatattctcaagaccgaggtgggtaggcctgacacagaagggtcaggaggctgctagaatctatgacagggcaggaacagcgctgaggcagcagaaactgagaaagcagaagtcaccagaaagagaaaagaagttcaaagtagagggaaagactgaggaaataagcagggtgagtcgaacagatgagatgtgcagagagaagcagatatgagctgagggagagagactcaatgaaccacgagaggtgggcaaagaaagcagccagtcctgaggttaccttgtttctgacagtttgggtcctgcccatcctttcttttttttttttttttttaagtgattgattgttggttgtttttttttattattattatactttaagctctagggtacatgtgcacaacgtgcaggtttgttacatatgtatacatgtgccatattggtgtgctgcacccattaactcatcattaaacattaggtatatctcctcatgctatccctcccccctgtccccaccccacaacaggccccagtgtgtgatgttccccttcatgtgtccatgtgttctcattgttcagttcccacctatgagcgagaacatgcagtgtttggttttttgtccttgcaatagtttgctgagaattatggtttccagcttcatccatgtccctacaaaggacatgcactcatccttttttatggctgcatagtagtccatggtgtatatgtgccacattttcttaatctagtctatcattgttggacatttgggttggttccaagtctttgctattgtaaatagtgccatgataaacgtacgtgtgcatgtgtctttatagtagcaagatttataatcctttgggtatatacccagtaatgggatggctgggtcaaatggtatttctagttctagatccttaaggaataaccacactgccttccacaatgcttgaactagtttacagtcccaacaaaagtgtaaaagtgttcctatttctccacatcctctccagcacctgttgtttcctgactttttaatgatcgccattctaactggtgtgagatgatatctcattatggttttgatttgaatttctctgatggccagtgatgatgagcattttttcatgtgtcttttggctgcataaatgtcttcttttaagaagtgtctgttcatatccttcacccactttttgatggggttgtttttttcttgtaaatttgtttgagttcattgtagattctggatattagccatttgtcagatgggtagattgcaaaaatgttctcccattctgtagcttgcctgttcactctgatggtagtttcttttgctgtgcagaagctctttagttttattagatcccatttgtcaattttggcttctgttgccattgcgtttggtgttttagacatgaagtccttgcccatgcctatgtcctgaatggtattgcctaggttttcttctagggtttttatggttttaggtctaacatttaagtctttcatccatcttgaattaatttttgtaaaaggtgtaaggaagggatccagtttcagccttctacatatggctagccagttttcccagcaccatttattaaatagggaatcctttccccatttcttgttcttgtcaggtttgtcaaagatcagatagttgtagataggctgcattatttctgagggctgcccatccttatatcaccaattcaattgaggagactcgaccaaatgttttatttttctaataactgttgccagtagtattctgggaaatccttctagcctgttgggcagtgagtgaccctcatcatatatcagtgcaatttcatgatttgtagatcacttattatgactcagtctagtcccatgttttctaatagcttttgagatctaattcatataccatgcaattcactcatttagagcaggggttcccaaaccctggactgtgaaccagtacccatccatggcctgttaggaactgggctgcacagcaggaggtgagcacccagcaaatgagcattaccacctgagctctacctcctgtcagatcagtggcagcattagattctcatagcagtgcaaat

SEQ ID NO: 374 - DNA, 14214 bp, Homo sapiens
  Region Adjacent to the Coding Sequence of PDCD1LG2
tcctgttgtaaactgagcatgcaatggatctacgttgcttttcttatgagaatctaactaatgcctgatgatgtgaggtggaacagtttcatcccaaaaccatttccaccacccttcccacaatgcacggaaaaattgtctacgacgaaactggtccctggtgccaaaaaggttggggattgctgatttagagcatacctttcagtggtttttagtatatgcacagagttctgcaaccaacaatataattaattttgaaatattttcatcatcccaaaatgaaatcccatccctctagcagtcaccccctagttcccctcattcctcccagtcttaagtaattatttcctgtctctatggatttgcctattctggacatttcgtctaaatggaatcatacaatatatacaatcttttgtgacaggcttctttcacatagcataatgttttcaaggttcacacacactgtatcacgtatcaggactgcattcatttctaaagctgagatatattccattgtatggacatactgttttttattgtctcattcatcagtctctggacatctggtttgtttccaattttttgatactaagaataatgcttctatgaacattcatgcagacatttttgtgtgtacatttcatttcttttgaaatatacctaggagtagaacactgggtcgctatgtttaacattttgaggaagtgacagagttcatctcatttaaaattccaatcccatattttacaaatatgagatattttacaaatatctctcctcccagaataggtgaaacttatgaccctgcaatcttcaagttgggcagagaaatggctcaggtctcaggcggttgcagtctaagggtagtggcctgtgataatggctggggcctcccatgcctttggcttccttctcttctgcatcacacgaagccatagtaactgttggggtttttggtcatccttgaggactcaggagcctgggatgtgaatgatatccccattttcttcattcctgaaaataagtctacagcccttttcactccccgggtgtgggacacccagtgaacctcccattttcagaaacttcaggcaagaagcaggtattaatctctatacaaggcactctcaaactttggagatatgcgtttagcaccccttttctctccccaagaatgagaggagactcagataatatacatccactctaggctctcggaaccttctccctgtctcttagtctccttcttacttgtctttgttcaaggccagtgggccagtttaatttctctcctcctcctctcttctctcctctcatttcctgcccccaaccctgcacttgaaagactcattgaaggaattaggcctgactttattttttttaccatattaacaaaacgatatttctttttgaaaaatttatttttattatttttaaagacagagtcttgctctgtcaccctggctggagtgcagtggtggaatcatagttcactgcaacctcaaactcctggactaaaatgatcctccctcctcagcctttcaagtagctgggactataggtgtgtgccaccactcctggctttttaattatttttttaattgacacataaataattatatagatttatggagtagagtgtgctatttcgacacatgtctaagatgtattataattaaatcatagtaattagcatatccatcatctgaaacttttatttctttgtgttggaaacactcaaaatcctctcttctagctatttgaaaatatagaatacattgttgttaactgtagtcaccctacagtgctatagaggccttacttaaatttgacctttgtgagttcagtaacttttcctcaacaagaagccatctacccagttatttcttcactattcagtaacatggggcagaaaaaaatacttaatcagtgccccacatcaatctgttacacttataataaatctctttttattttgaaaagttcttttctgtgaatgagccaaacctagacctctctccttctaagaacaaacaagtatttcagttgctccggccagaacttcaattcacacctttccttctcttactttgagaccaggcctttcttagcacatagagaccaggtgggactgcaagccaagtgtggactttgaggatgatgaccagtgactcacctccagcccctggctgaccatgacacaagggaggccaattttcgggctggcccccatgtggtctccctcctcctcctctcttcccccagctgctcatgacctgcctgccccaccccagaaattccttgtccccattttctttttcatttgagacagagtcttgctctgttgcccaggctggagtgcagtggcacgatctcagctcactgcaacctccgcctcctgggttcaagcaattctcctgcctcagcctcccaagtagctgggattacaggtacctgccaccatgcctggctaagttttgtattttttagtagggatggggtttcatcatgttggccaggctgatctcgaactcctgacctcaggtgatctgcctgcctcggcctcccaaattgctgggatttcaggcgtgagccaccgtgcccggccccctctccccattttcaagagattaagctggtcttcacctgcttccttcacattccagataaactcacagcagatccctgcttcctgactttggaaacgttgctaaagcaggttctagataaactgctgcctcctcatttctcacaccttccttagctcttgctctttgcctgttttcccaaaattcaagtgcatttctttctcatcctcaagctgtatttttttcccttataaaaccaagcagagtgggaaatactggacttatttttttggacctgaaagcattaacattgatttagcacctgctgtatgacaagcactgttctaggtgatttacatgaatatttacatcatgtcatattacaatatattacattacatcgcatcacatcacatacattgtattgcatcatattatattacattgaactacatttgcattacactgcatttggaggaaaatatcttgggaggaaaggacagaaatggttgtagcatttcttacctactctgccctacattcacagggtgatcttggttaagctctgtaatctctctttgtattaactttcccttctataagataggaggggcctcatagattggctggtgacataattattaaactcattatattcttattatagtctaatagtttatgaccaaaattctaattttctatttccaagtgacaatgcaatgttgaagggggtgcctaattctacacacagacacacacacacaatttagctatgcctctcaggaatcttctattaaaaagagaacaaagctaaattaaataaattgccagccaggcatggtggctgacacccgtaatcccaacaatttgggaggctgaggtggatggatcacttgagctcaggagtacaagactgttaggttttgaagggaaggcgagacttaaagaaagacacacacacataagagggaagttcaacaacaaatgcagactttatatccagcataaaacctacagaagtcagagaccagtctaatgccagtacctgctgctgcttataggctggggcaatttataggtatgggcaggaggggtctgggcagtatggcttgctgcctggcaggaaattgataagatggtcccatgatgaggcagttctggtccttgttcaggcaggatgtcatcatggtgttccttggacctttgcccagaaggtctttgccttctagtttagcataaaaaggaagaggggcattgttaattatctggctgtttcctgctaaataggagcactgcactcaggctttgggttttcagcagtgggtgtccgactttagagttgttttcctggaagtgctgataccaaacttggcagagaagaatggtatcgtgtttctatatagctgcctggacaagggagttcggcctttgggagataaagcgggatatgaaggtgcgcacacatgggccaattgtcagtattatgagggagaaaattagggaccctaagacaggggttacccaaggtatccactttaggaaggatgacccctgccaacagtgaatgacttgatgttggatttctgcagccgtgtaatggagcctgtgggctgcgttgcgaacaatgccggcttcattaacataaaaacagcattcttcttggacatatacacatgtgccccaagacaagaatgttaatccaaactgcaccattttgtaagcgccctgctattttgcagaccttggtaaaagtgacacatttcatgggtttttgggccatgagaaacaccctgcctaaccacttgaccacaaggcccacaaaggcccaactaaagaaatatctctatcatatccttctgggcaaaggtccaaggaacaccacgatgacatcccgcctgaacaaggaccagaactgcctcatgacgggaacatcttatcaatatcctaccgggcagcaagccatactgcccagacccctcccgcccatacctataaattaccccagcctgtaagcagcggtaggcactggcgttaggctggtccccgacttctacagtgtgcatatttctttaaccctcgccttcccttcaaaacctaacagggatcagcctgggcaatatggcaaaatgccatctctgcaaaaaaatacgaaaattagctgggtgtggtggcgcatggctgtggttccagctacttgagaggctgaagtggtaggatcgcttgagccccgcaggttgaagttgcaggcagccctgattatgccactgcactccagcctgagtgacagagtcagaccctgtctcaaataaataaataaataaaaataaattagaaacacatacagccctttgttgatttctttaaatgttttcttcttgttatttttcagtaatctaactatactctccattattgcttttaaaaaattatttctgtctttacaaaagtaatttgtgctcatggcagactatttaaaaaacaaaatgaagccaaagaaagaaaataaaaattaactgcaggagaaggaggcaagagagctaactagatgcagccaggagaaacacctctcacagagatcttcccagattttcagagggaaggcatcaagagtggacagagggaagacacagaggctgggctgaagcaggaggaagctgaaaaccctgcatgaggctaccacacactgggacttgttcctggcccccaacaactcctgcagaagggatgagttgaacaggcaaggagaaacatgctcttgcaatgggtctctggaatcacgacaggaagagacccctcaaccactgtggacacttgagttggcaaggagagctgcttagagaagtggtaggggcagagctccaggtgatgtggagcccagtaggtttcgtgcgggagtgtttgtggtggagtacagccagcgatgtccatctccctaggctcaacttgcttccataggagactttagcaccaggggagctgtcggtcctaaattctgcagggcggtgttgcccatgagatagggccagtctgacttcagcaccctttggtctgctagcctttcccagggccccagcctgtccatgcctgcttgcagtgcagccaccaggtacctcctgggagcccacatcatagcacctgtgctggcagaccatgccagactgtcagagtgctgcagcagagtagcccccatggacacacaccagcccacccagctcatcccctaactacagcctcccccttgttgctttgcttgcacacacttgcccacagccacccttcatatcactttgccagtacctgcgtgtacaggcagacctcaccttcccttccccaccagcatacgtgtgagcgtgtgccctgccatgccactgctgctggtgtgagtatatcctgcccctcctttccctgcagcactgtccactgtgatggcaatggcattgtcatcagagtgttgttgggcatggagctgccagctccgccccagccagtccccagccctgcccctatgcgaacactgcctatggcacaaaactaggcacaaaaaccagcaggcccacccctgccctgagcggccaatgcctcccatgtgaatgtgcacagggggcacacacagccctgcatctagcagcatcctgctcccatgctaatcccaacactggcacaaacatgtgtacagttgctggtgagggccccccaacctgcctgagccatgctgccactgctgcttctatgaacacctgcacgaaggctggcactccggcatccactagcaccttgctgcagccaacaagtgtgcaccccactgcaccgctgctgccactgcgactggcacatgcgactgaggatggatcatgtttccacagccctacaaagcactttggctggcaccatgcctcagagagttgtgatcagaggtccaggagcacctcaggcccctccaacatagcaggttcctaaccttaaggagccagagaacaagaccggggcctgataccagtgccccagagttataacacacagtttgggagtcctgagctgagacttgggcccctaaaatcttccagaaatgaagccagtctactgaacccaccttataccacaatcaaaccccgaaggtcattaaatatgatataaaaagggggaaaaaaaaacaaaaacagcaacatcaaagattgaaggaacatcattctacaaagatgagaaagaaccaagataagaactctaacaactaaaaagccagatggtcttctttcctccaaacaatcacactagttctccaataatggttcttaaccaggctgagatagctgaaatgacagaagtagaattcagaatattgataagaacaaagatcatcgcaattcaggagaacactgaaacccaatttaaggaagctaagaatcacaataaaacaatacaggaggtgacagacaaaatagccagtatagaaaagaatgtaactaaactgatagagctgaaaaatatactacaagaatttcataatgcaattgcaagtattaatagcagaatagaacaagctgaggaaagaatctcagagcttgaagactgactttctgaattaagacagacaaggagacagtcagacaagaacagagaaaaaagaataaaaaggaacaaacaaaacctttaagaaaaatgagattatgtaaacagaccaaatctatgacttattggtgtccttgaaagagatggggagaatgggagcaacctggaaaacatattccagcatatcattcatgagaacttcccaacctagctagagaggccaacattcaaattcaggaaatgcagagaacccccacaagatacttcacaagactgtccccaagacacataattatcagattctccaagatggaaatgaaagaaaaaaatgctaaaggcagctacatagaaaggaaaggccatctacaaagggaagcccatcagactaatagtagacctctcagcagaaatcctacgagccagaagagattggaggcctatattcaacattattaaagaaaagaaattccaaccaagaatttcatatccagccaaactaagattcataagtgaagaaataagatatttttcagacaactcaacgctgaggtaatacattaccaccaggcctgcctaacaagagttcctgaaagaagcactaaatataataaggaaagacagttaccagcctctacaaaaatgcagttaagtatatagaccagtgacagtataaagaaaccacacaaacaatgcacagaatggcaagctggataaagaagcaagacccaatggcatactgtcttcaagggactcatatcacatgcagtaacacacataggctcaaaataaagggatgggaaaaaatttaccaagaaaatagaaaacagaaaaaagcaggggttgcaatcctaatttcagacaaaacagactttaaaccaacaaagaccaaaaaagaagaagaagggcattacataatgataaagagttcaacaagaagatataactatcctaaatatatatgcacccaacacaggagcactcagattcataaagcaagttcttagagaccttcaaagagactcagactcccatacaacaatagggggagacttcaacaccccactgacaatattagacagatcatcaagtcagaaaattaaaaaagatattcaggacctgaacttaacactggaccaaatggacctcatagacgtctacagaactctccacccaaaaacaacagaatatacattcttctcactgcctgccacatggcacatactcccaaatcaacgacaccatcagacataaaacaatcatcagcaaatgcaaaagaccaaaatcataccaaccactctgtagaaccacagtgaaataaaaatagaaatcaagactaaaaaaaaaattgctcagaaccattcaattacatggaaattaaacaatctgctcctgcatgacatttgggtaaataatgaaataaaggcagaaatcattaagtttttttaaaccaatgaaaacaaagacacaacataccagaatctccaggacacagctaaggcagcgttacaagggaaatttatagcactaggtgcccacatcaaaaagttagaaaggtctcaaattaacaacctaacaccacaacaaaaagaactagagaagtaagagcaaaccaaccccaaagctagcagaagacgagaaataaccaaaatcagagctgaaatgcaggagaatgagacatgaaaaaccattcacaagatcaatgaatccaggagctggttttctgaaaaaataaataagatagatagactgctagctagactaataaagaagaaaagagagaaaatccaaataaacacaatcagaaacaacaaagggaatattaccactcaccccgtagaaatacaaataaccatcggagactactatgaacacctctatgcacacaaactagaaaatctagaagaaatttataaatgcttggacacatacacccccaagactaaaccaggaagaaactgaatccctgcacagatgaataatgagctccattactgaatcagtaataaatagcctaccaacccccacccccaaaaaaatgcccaggacctgatggattcacagtcaaattctaccagatgtacaaagaagagctgacaccattcctagataaattattccaaaaaaattgaggagaaggggctcctccccaggtcattctatgaggccagcataatcctgatactaaaacctggaagagacacaataacatcaacaaaaaacttcaggccaatatccttgatggacattgatgcaagaatccttaacaaaatactaacacactgaatgcagcagcacatcaaaaagcaaatccaccatgatctagtaggctttatacccaggaggcaaggttggttcaacatactcaaatcaataaatgtgattaattacatagacaggactaaagacaaaaaccacatgattatctcaatagatgtagaaaggttttttataaaattcaacatttctttatgttaaaaatgctcaacaaactaggtattgaaagaacatgcctcaaaataagagccaactatgacgaactcacagccaacatcatactgaataggcaaaggctggaagcattccccttgaaaaccagcacaagacaaaaatgccctctctcaccactcctattcaacatagtattggaagtcctggccagagcactcaggcaagagaaagaaagaaaaggcatccaaataggaagaagggaagttaaacaatccctgtttgcagatgacatgattctatatctagaaaacccctagtctcagcccaaatgctccttaagctgataaacaacttcagcaaagtttcaggatacaaaataaatgtacaaaaatcactagcattcctatacaccagcaacagcgaagccgagagccaaatcaggaacacaattgcacttgcaatttccacaaaaaaaaaaaaaatacctacgaatacagctaaacagggaggtgaaagagctctacaatgagaattacaaaatactgctagaagaaattagagattacacaaacaaatgggaaaacattccatgctcatggataggaagaatcaatatcattaaaacgaccaaagcggtttatagattcaatgctgtttccaccaaactaccagtgatattcttcactgaactagaaaaaaatattttaaaatttatatggaaccaacaaagagcccaaatagccaaggcaatcaaagcaaaaagaacaaagccagaggcatcatcctaccagacttcaaactatactacaagggtacagtaaccaaaacaccatggttctggtacaaaaacagacacatagaccaatggaacagaatagagaacccagaaataaggctgcacacctacaattatctgatctttgacaaagctgacaaaaacaagcaatggagaaaggacttcctactcaataaatggggctgggataactggctagccatatacagaagatggaaactagactccttccttacaccagatacagaaatcaacttaagatggattaacaacttaaatgtaaaacctaaaactataaaaaaccctggaagacaatataggcaataccattctggacatagaagtgagtgaagatttcatgacaaagacaccaaaagcaattgcaacaaaagcaaaaattgacaaatgggatctaattaaactaaagagcttctacacagcaacagaaactatcaacaaagtaaacacacaacctacagaatgggagaaaagttttgcaaactatgcatctgacaaaggtctaatatccagtatctataaggaacttaaacaaatttacaagaagaaaacaaacaacccaattaaaaagtgggcaaaggacatgaacaggcgtttttcaaaagaagacatacacatggccaacaagcatataaaaaagctcaatattacttatcattaaagaaatgcaaatccaaatcacaatgagagatcctctcacaccagtcagaatggctattattaaaaagttaataagttggccgggtgcggtggctcacacctgtaatcccagcactttggaaggctgaggcaggtagatcacaaggtcaggagatccagaccatccaggctaacatggtgaaaccccgtctctgctaaaaatacaaaaaaattagccgggcgtggtggcgggcgcctgtagtcccagctactcaggaggctgaggcaggagaatggcatgaacccaggaggtggagcttgcagtgagctgagatctcaccactgtactccagcctggaagacagagtgagactccatctcaaaaaaaaaaagttaataaacaacatgctgacaaggttatggagaaaagggaatgcttatacactattggtggagtgtaaattagttcaaccattatggaaagcagtgtggcaattcctcaaagagctaaaaacagaactaccattcaatccagcaatcccattactgggtatatacccaaagaaatgtaaatcattctatcacaaagacacatgcacacacatgttcatcatagcactattcacaatagcaaagacatggaatcaacctaaatgcccatcaacgacagactggataaagaaaatgtggtacatatacaccaaggaatactatagagccgtaaaaaagagcatgtcctttgcgggaacatggatggagctggaagtcattatgcttagcaaattaatgcaggaacagaaaaccaaataccacatgtgttcacatataagtgggagctaagtgataagaacacatggacacaaagaggggaacaacacaaactggagcctagctgagggtggaggccccagggaggagggagatgagcaaaaaaaaaaaaaaaaaaaaaaaaaaaaaaaaaaaaaatgactgggttctaggcttagtatctaggggacaaaataatctgtatgacaaacctccatgacacgagtttacctatgtaaaataaaagtttaacaaaaaactaaaaaagttacctatgtaaaacaaaagtttaacaaaaaactaaaaaaagttacctccacccagaaatgcctttattaacactttggtttgtaaccctccattattttctctagacatatagatttatgaggcaggctaatgtgctgagacactagcttgagtttcatttggccttgctgtgaatatacctgggccttcctttgcttcaggatgccctaaactgtggcaaagcagagctgaactgcccaaaggaaagtgtgaagaggagaggcaggccaagcctggagaaaggctacccaagagagaggaaaggaaactgtggtgagtgcacctcactcctaaagaaggacaggaactctggtaggtgaggtgtgttttccatagatactaaaactcaaagccacacaggggacatatgtccattcctcagccagtcactgtggccaggaacagagggtcaggtaagagaatggcaactcctaaggaaaccacatgcctggagccgtgggtgtagaagcagatccccagaggaagcacgggtcccacagacacagtcccaactcttgccgtctaggcagccactcccatctgtaggtactacacagcttcgtagtacttcttaaagtacttcttgttcaagcgatgggacgaaaagaggatgcaggacaaggaggaggaaaggagatccttgcttttgtagaagaaacaaggaggcagggaaggcttagaggacaggcaaggagagatgttttcttaaaaacatcctctgtctgagtgttcagccccacatctctgctggtcctacccctataagcacaaggaaaagggcgggaggcagcaggagaaggattgatcattcaggcctatattcaagtttgccttttcttgccatgtggttttaatctcaccaatcacaagcctgaaggtatagtggggccactgaggtccgagttcaaattcagccatgcaactaaggaaacattgtttgatcttggtcctgttttctcatgtgtaaaatgggtctaactctaaaccacacattgcactgagaatgaaatgaggcactatgaaatgaagtgaggttagttgaataatgttccccccaaattcatgtctactgaggacctcagaatgtgactatatttggaagtagggtctacgcagatgtagtctaaatgaggtcatactgcattagggtgggcactaatcaaacggatggtatcctcataagaggagaggaatgtagagatacacacagaaaagaatgtcatttgaagatggaggcagagattggagtgatacaactataagtcagggaatgccaaggacttgaggtcatgtgttacagaagccctaggaaatgagtcaatttcctggcacagcactaagacatgctggtattcttcattccatccctttcccctattcctaaatgtgctccagggacaatggggaagctggagcacatataagaataggggaaagagagggaataaaagggtattaaaaactctcaaggtatgttaaaaaaaagactctcaacaaaccaggtattgaaggaacatacctcaaaataataagagccatctatgatgaacccacagccaacatcacactgaataggcaaaagctggaaggatgccccttgaaaaccggcacaagacaaggctgccttctctcaccactcctattcaccatactattggaagtcctggccagagcaatcaggcaagagaaagaaagaaaaggcatccaagaaggaagagaggaagtcaaactacccatgtttgcagatgacataattttatatctagaaaatcccacagtctcagcccaaaagctccttaagctgataaacttcagaaagtttcaggatcccacatgaacatacaaaaatcactagtattcctaaacaccaaccatagctaagccaagagccaaatcaggaatgcaatcccattcacagacaaactgctaaaagcaaaaccaaaactttccaaataagccaggctttcgtcagttcctcagaactagttctggtttgactcactctcatgttacggcaaaccttaagctgaatgaacaact

SEQ ID NO: 375 - DNA, 10748 bp, Homo sapiens
  Alternative Promoter of CD274
tctgagaacccaaaggagtcctaaaagaggaatggaggagcctaagaataaaaatagtataataaaacatttcttagacacattgaccttggcctatgtcaaagttcagtctgggtttgtcttataacacaaggagtaaaagtaccattgttctacctctttttttaatacttgaaaaaaatttactgtggatgcttttctatgaattaaataaccttctaaaaaatgttttcattgctgcattcgattagattgggtaactaaatgaaattaattcctcactgttgggtataaaggttatttacagtggttctgtcttagccattcactgaactcattgcatatatatctctggaatattgctgattgtttccttcaagtaaacttagaagtgtaactacttagtcaaagagcctgaatattttaaaggccttttgaagaaaactgaaaatgctttccagaaaggatgtatcagttgacaatgacagtcgtcaacagtatttaaggagaactatgatactctgaagaaaaacttagcctttctcagtaaaagtaggtaggcagaggccacatgacagcagttagagtgtggtcttcaaggaagtcacagaaatactgtggggaattgaaaccccatgtggaaaatgtacaagagtgtctcagtgtgactgagaaggaggttgggcatggggtttcatggagtttaataaagtttggtcacttagtagaggtttaataaatcaactgtcttaatctttgatcctacttaagaattttttttttgtttttgtagagatggggctcttgttatgttgcccaggctgttctcgaactcctagcctcaggcgatcctccctcctcaggctccagaagtcctgggattactggcgggagccaccatgcaggcctcttgctcctacttttgagaaaggaagtttaaccggttttttttgtctttttttttttttttttgagacagagtctcactctgttgcccatgctggagtgcagtggtgcaatctcagctcactgcctcccgggttcaagtgattctcctgcctcagcctcccgagtagctgggactacaggcacctgccaccacgcccagctaatttttgtatttttagtagaaatggggtttcaccatattggccaggctgatctcgaactcctgacctcaggtgatccgcctgcctcggcctcccaaagtgctgggattacaggcatgagccactgctcctggctgcttaactttttctctatctcatcctcctacccatcctacccttggaagatagagaagtagtattagttccatagtgttatactgggcttcccccagggacaaacccacttccccaacctgaatgagccatcacttcttccccagtttacatttcattgctctttaaatgtctccattcggatatgggaattcacatatggtcataattcttacctgaagaagatgtcagtcttcttctcttagaccaactgccctgatatgaggtttagaggttaaagaacatgtgtgtatttacatgatctttgtattctgccttttcgtccctcactaatgacagctgcaccccaaggaaatggagctgtggaagagagggtttgataagaaattaagtaaatattggatctaatccatcaccctccaggaagcctttattactcctaaaaatttcaaccaaattcattaaaggacaagaactccaccagagtaggccataaacattggcaaaattagttgtaatccatgactagatttaatgtccctttgttttattcccatatggttataatgctttgcttggcattaggggtattttaagttttcttctgcctagtaagtgaatttgtgtttataatacaataatcataaaatatcacattaatattttataactgtacagttataaaatattttataagtaatatttatattttataagtaatattttataactgtacagttaactctggcccaaggaaaagatagtctgatagatgctgcagccccattttagcaaatgtgacctcacaggcctgaatgccatcgctattccacatctacaggatagacggaaaggaaagaaataaaaaaataggtacctaacactggcaagaggatgatgactcatgttatttcacttaacctttttatcttttaacatgaaggactcatacaggttgataagaaaccagtgacataaacagaccaaaaaatgatcagatctttcaaattagcaaaaaaataatattttttaaacaatgggtgaaaatacagtgtaacagtaccaattatcaacatgtgttgagaaccagaaaaatgttctttttctttgatcagcaacactatttgggaaaatctatcctcagggcctagcctggggccctggcacacagtaggcactcaacgaatatttgctgaacacacaaatacttatgatattttaaaaaattggcaacaatctgatacctaacaatagagggattaaatattatggaactgttaaataagatgcttatgaataccatgcagtaagatgggcaatatttatgccataagctttaatgaaacaaatgggtattaaatgtatgataaggttataaattactttttaaaagattacagggaaaaaaattgaaagatatacactgaaatgttttttgctcacagtggtgacaaggtttctcagcactggcactgttgacgttttaggctgtatgtctttgctgtgggaggctggcctgtgcactgcagggtgtttggcagcactcttggcctctgcccctagatagcaatagcagtcctccctcaaccagcccaattttgacaaccaaaaatgtttccaggcatcaccagatgctccctgggtgagagtgatgaaatagtaggggattttccccttcttttcttattttctgtaattccattatattactttaataataaagaaaaaaacataaaaaataaacgaatgttattattctacgtcagtttggatgtttggactccattttggggttctttccattatatcacttggtctgctaaacattctacggtttggtaaggtgaagtgattcatgaaattttggttttatttttttcctgatactaaaaataaaacattctttcacttggaaatttggacacagaacaccaaaaaaaatccataatctcatctctctttttctgtcttttccttccttttttccctttaaaaacaataaagagtgaaacctacctgttctccctctaatttaattcctaaatataatcactgtcaatatcttggacatttcctgtgtctaaacacacacacacacttttttttttcagcaaaagtggatttctgctacatgtagtgttctgcaacttactttctatgtgtttacaaaatcagtacatgtacatatgctgaattcagtccttaatggtattatattttgtgaatataccaaaatttgtttaaccacttagacaatctaggatattctcagtttgctgttatgagcaatgctcttcctttacatatacagacatatatatatatatgtgtgtgtgtgtgtttttgttttagtaggatagatttctaggagagggtgaaaggtcttatgacatccgcatttacgattgtaataggaagtatcaaagtgccccctaaagaaaaaaatcctcccattagtgggtaagaaagcctatttgttcatatcttcacaaacactaaatattagaaatatttacaattgtggtcaagctcataagtgaaaatggtatttcatatcttatattttttattgtgagattgaacatctttcatatgtttacatgtcacctgtatttcttattctctgaactatatgttatgacctttcactttttttcctcatgggttatgtgtagtttgtatagttgtcttattgattgttaggagctatttatatattaggaacattaatctcctgtcttatatatacgtggcatcgattagttgatcatttgtgagttcatgtctgtatacaaagattggagaggcactaagagggaaaacttacctctttcttatcaaagtttgtaaatatatgtataacagaagagggagaaaatattaataaatgcacagattggctgaaatagagtataaatcttttactcccctacttcaacataaactgcaaaaggagagtgacttttctttcactctgacttccgtattcctcatgcttaaaatagtgcctagcacagaagaggtgctcaatcagtgtttgctaaacgaaataattagtcacatttcaagcaggatgactaaatgaagaatagaatctaggcagatactctggaagagtggctgtgagtcattcatatcttagtatgaattagtcaaatccaactctctccccttcccactccccactgttagtagaagaatctgtttattgagagaatagatttataatttagaataagtgagaggggcagaagaggagattttgaaggatggcacctgaaggaggactagcatggctgagacagtgaagtggaagccttgaatagctaaagggtaagatgaaagtatttagctgtagggggaaaaagcattgacaggttggaaaagtaaaagtcagattctccttgctctgaaattttgtacagggcaggttctactaggtatgttacaatgcagaaaaaacatgaaataattgagaggaatttggtgcaatattatcttcttggcttcttttgagtgggcagatttttttcacggcctgtaactataataaatttgaaacttctcatcttttagtaacttttttcacttaagtttatgtggctgtgggcaatggaatgaagatattgaacttccaattccctgttgggtttccacaattacaagtcaatcatgactggttattagaagactatttcagttagaaccaccaagtcccatattgtcatattgtatgtttaattattaagtgaagcagtcttcttttcgtgttttccataattagggcattccagaaagatgaggatatttgctgtctttatattcatgacctactggcatttgctgaacggtaagacaccaaatccttccattaggttctatattttaaatattttaaccatgagtttaaaactaaaatgatcatttaaaatgcatgcaattttcttatagagagaacattctattctttcttctactttacacaatggcaaagtcttctttctactttacgcaatgataaagttacctgtgtcattttgtaaaaatatagagaatatagacaaattgaaagacacaaaataatctattacccatttcccagggttaactactgaaaatatctggggaaatggcctgtatgtatacatttatttgtttgctttcaacaaggccaagatcctttgatctttcagtcttggttgctctgtgacatgcctttcctgatgaggatactttaaggaagaattgtaagatacatggaaaatgtcaggctaacacagtactggcatcaccctgtgctctttcctgaactccataccaatgtacttcttgccagaaaactgatcaaaagtttagggaagtaaaaagagatgactgttagaatctaccattccctctatgtaggaagcaaataggtgtcctgtcaaaggacattctggggatgtctacatgaaaccaagtctccctggttgtaaggactccatctccatataatatttatacagtaatatatgtttataaattgtgggggcaacttgtttagctaattttattattctgctattgggacactgtgtctcagcatgagatatagtgtcccaaaacatatttcaagcccattggataaaatatgtgtttagcaagttcttaaatataatgataacataaccgaccagataaagtgatttataaacgctgtgccaattttgtaaatgtttcgaggaattttcccttttctgaagattgtccttctttctttttagcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatggtaagaattattatagatgagaggcctgatctttattgaaaacatattccaagtgttgaagacttttcattcttgtaagtccatacttattttcaaacagaacagcatagtctgttcattcattcattcaattcatgaattcattcacataattatccaatttcttgagcacctatttgatagtcactggaaatccagagacaaacaacacagagccatgttctacagtatgtacagttttccaaaaagaatttctagtctttacttttttattacaaatggaatacgtatacttgcaaataattcagatactgtggaagagatcaaatgaattgcaaaagtgtccctcctcccttcaccactatctcccatggcatgcagagagagtaaccattatttgtgtgtccctccagaaatttttttattcaactactatttttttattttattaggtccgtcagttttccttttttgagcctctctatatcaaatgcaaataaatatattcagaacaaaccccactgtaaggttcacattaaaaaagacttgaagtcaccctatgaagacaaaaaataatcacattaagtgtgaaagaacctattcttccagtacaggataagccatacttactgggcatatattcatcttgaaaatctatactgatgttgtcttggggaattgaaaaggaactaggagtgttagttcctcggtattgacccacagttatgttatcaggtcacttgagttcaaagttttgtgttggcactagctaagtaaaggaaaacacctctgctttcattgttgagtttcacagaattgagagctgaaaggatcccaggcaggagcagctaatccaaactcccacaaagaacaaaaatcccccagaggatcttctgttcttatatttcctgcaatggcgtccctgtcatatcccacaatggcctccctgccatttggatatcccttccatatcctgttgaaattactccctaatagtaagctgaaatctgcccctctagttgtagtcttgggattatttcatttacatgatgaccttttaatatttgactagaattaaatcatctccccttggtctttccattcctgggctaactaccatcaatctgagggctaacaatacaagtagaaaaagtatacatttgtcactgatcactgatcaattattaatcaatgatcactgataactataaactcaaaaacaaaatcatgtggggattaagagaaatgtatcagttttatgttgtatttctggtccctgatactggctcaggtaatgccactattgtcaagaagataccacttgtaaagtagatttaattttcattatattttaccatatgcttctccattcatgacatctcttgagatgttgtggtttatactttcagtttttctccagtccatccgcaaatatcaggcatctactgtgttccaagatattaaagaaatcatcatgacttagcctcatcaacagcattgctagatctgggatggaaaggaagagtataatcctggcagtcaggaagaaggcagcataaagtataagtttctgcttccaaaaaaggtctctcatcagcctgtagggagtgtgtagggaagggacagctgtccttgtagtagggaagggttttattcaggtcgtctgggctccataatatcccttgtgtatctgcagtctcctttgccatggatcaacacaataggaaatcttccggcactgatggtttttccaagggggagttcttcctggagcaaagcaaatgaccaaccaggtttgaggacctgatttgtttgacaattccattttgtattgtaaattacttaattggcattctactcccaatccatcttgtcatttgcatacagtggttttgggattgagttcagctataccaaaagtctgaaccttctgcacttagaacaaggcaaccaccaagcttcacttgcactgaggccgtgtctccaatggaaatgaggcagctggcttgcaggagcttcccaactcagggaagtagaactcctgagtcacctccatatgcaaatgatttcacagtaatgctgttgaacttcacttcccatcacagcaaatgtgtggtaacatagcttccccacaggagtttactcaccatggtattttaaaggtgaaacatttcaaaactgaaatttgaaagaatttagttttggattcactcaattatcactatcacttcgggtgttattgcacctttcttgtttgtgagtttaaatgccagactctcaggccactaactttcaattaaaagtgtttttctttaatcgctgaacctaacagcagggaaaacgaaatgttcattcagactttcagaaccttcaatgagattaggcagctgaaagatcaaagtgttgcatagttgtcccgataaagctatttggatcatatggaccaaatcgactgctgtcattccccaccaaccccatctctccccaaaattcccagccctgtttaagtgttctctgtagcatttatctctatctagtatattgtgtagcatatcatatcatacttttctgttttgtttattgtctctctcctcctagaatataaactccacaagcacaaagatttgggcctgttttataatattgttgcatccccagggcctgatatacagcagagtggtggtacgaaaagagcacacaaaaaaatatttgttgagtcaatgaatgaatgatttcctcaaataggattagcctaaaattttggaaacatgaacagatttggatatgtgaaaatttatttccagactgttcatcaggaactgttagcagcttctaaagggtacactggagcagcagtagtaaaaggaggaagaggagcagctctgctactgctactatcgagtactactacaattagcacttgcttattctgtgtgttaggccctgtactgaacactctgtctaaattagttcatttcctcctggaaatgactctagggggtaagtgcttcatcatgtaagatgagtatttttcacattttgttgtgtctgaaatctgagtgtgtctttcaatgatggaatctttgattccatgataagtggtattattcccattttaaggatgaggaaactgaggtccaaagaaattaagtaatttgcccaaattcacccagcctagaaaatgataaagctagttctaaacccaagcagattagctctgaagtctgggcccttaataaccactttttattgcctatatttgtacctctggtgtacgtatcaagttatatgttgacttcaaaactatcatgaccttttcttggttttgattgtccaacattagtatagtgttctgggtctgcaaaaattttgattactcatctcatctgtaaaacattttgaactcgtgtgtttgtgcatgcacatttgtgtgtaattataaaaattttactttctgttaatatataagttgtatcataagaaactgccgtttttgaagagcaaaaaaaggttgaatgttaccagttacatctggttcaacctaatagacatttgtacaaaaacagacattttaagaggttgaaataaaaatttaataaacaatattttcagtttttactaattgtgatgcttcactatcattagctaatatgtcaaggcataatataccttagggtgaactttatcattaacaaaggtggatggtgtcaataatcttgaggtttgtgtttttttatataacactgcgaggtctaattaagtacttactgtttaccacctcatacagtggccgataaaaagtgtcacttctgctgtttcctctgggttgtgcttgaattattagtattatcttcagtcctcagtttctttgtgggaaactttttaattagttgtttaattttgtaagatggttagtttagtcaaaattagataagagaatttgaaaatccgtagctaccccaaagcaacctacacataagaactattatttttgtgttttgaaatcataattttattgatttccagtgtttccactggtagtggtttcattgatataggagtatcaaaacatcactcattatttatttcagtttcatttgatcctagccgttttgtattaactctctgtgaagaaattacctcacaaatctattgctgtccttggtaaaggaatggagaattaaggctctagatcattagtggttacactatagtattagaagtaaaaaaaagattataccaacaaaataagaacatgttaatgtacttgtaatgaataaacatgaataaagctcttatgctatataggtgcactaaacaatctactagaattgtcagcaaactacgtatcttaatcctgaaagggtcccaaaccaatgatctaaaattgaatcaaact

SEQ ID NO: 376 - DNA, 10598 bp, Homo sapiens
  CTCF Binding Site Upstream of CD274 Promoter
ccagcacaccatttcttttttttgtttgtttttacactttaagctctagggtacatgtgcacaacgtgcaggtttgttacctatgtatacatgtgccgtgttggtgtgttgcacccattaagttgtcatttacattaggtgtatctcctaatgctatccctcccccctccccccaccccacaacaggccccggtgtgtgatgtcccccttcctgtgtccaagtgttctcattgttcaattcccacctatgagtgagaacatgcggtgtttggttttttgtccttgcgatagtttgctgagaatgatggtttccagcttcatccacgtccctacaaaggacatgaactcatcattttttatggctgcatagtattccagcacaccatttctacaaccttgggtttattgtgtttggaagcctagatccaaaggaaggaatgctgccactagaagaccccgtcactgaattgaattgaatttcaattcattgattcgaaagctgaaactgccctctggtcactttgattcctcacagtgacagaatggtatgattcatcccaaataccaaaaggaaattgggttacatctatatattgagggcaagaagaactatgcatgacacctggagattcactgggcacttcttaatactgccgtgtgccataataatgattatcagataactgaagtaatgcagaaatttcagatcatgaagaaattaaagtgttgaagcataccagataaaaaaatcctgatctacctaggtgttggcatagggcaggggaaacatacataagtaaatgagtaggaagctatgattattaattttagccttgcaacaagctctagaggcaggaattatagtagctctccatttaaaatgttaattacttcttccctgactctcttttcctattaccctgcataaagagtagtggtggagataaatattacaatttagtttctgggtgagaatgtgcctgaactgacatcccctcaaggcaatatggcagctgatgaggcttgttaaggaaaatcaaagctggacaatagctgtagcagtaaaaatagatttttattcagcaacttttgaaatagggggaaagagaccttggtaaagaactgggctcaattctgaatacagtaaggataagtggggatttatagccgaggagcaggttgtgtggatgggggtggggtccgtggatggaaaattactaagaagagacagcaagggtaggggaaatccttgctaaactgacctaacaggattcttgctaaaggtaggccagggtaagcagacatcacctgggggctggtgggggtaaggaatttgatcagatattgagagtggtcaaacattcagggtgggaagatcctctctaaactgacttagcaggattcttgccaacactgattctgcaaggatgaacactgcagcccaaggtcaatatctaatcaaggagatggcttagaggagcctgactaaagtttggtcgaggagaaatcttgtcagactctgtcattctcatatgtaagggatgagctgctcttcatctgagcaaaggaaaagaataaattctgggtgacaaaacaattagactgtctaggttttctgtttgccttccatcatattcattctcctcacttccctgccctgttctataccccaaagctgacctctttggacggcaccacctgggctctcctcagctggtttccatttgagtttggacagcgggaggcattcagggagatgggaggcaggaggaaaaagacatcagggtatattttctctgttctttctctgtttggggctgagtatctggtggtggttgtgtttctccacaattgcagctcttggcaagcagtcccttctccatggctccagctccatgggctctggaaacacttttctcctttgctatgtagcctagagagagcgcagtcttcctgctgttgctagactctggatgactcaactggatggttctcttagtcatactcctttaagtagtgtcttcactaatatctctttaatcaaaccaactgagtaaaattctgattcctgatggatacatgttaaaccgaaaacacacattataaattttcttgtatgtatgatgtttttcataattttaaaacataagtgaaaaaagtgaccatagaaaaatatgcccaggaaattgaaaaaaaaagtcttggtatagatattggacacattttataaaatgtggagtaagagggttaaaggaaatttatttcagaatcaaatggcatataactttaactggtatgtgaattattttcagttgtatgaatttgtgaatatatatgtgtacatttttatgcatatatataaatatgtgttttatatcatcttgcattataacataaggatttttatgttgctacattgcatttatatttaccatttttaacagctaaaggattttcaataagtgtgtatgtaacaacttccattgctggatatttctcagtatatatatgtatatatacatatgtgtgtatacatatatatatacatatgtgtatatatacatatgtatgtatatgtatatgtacgtatgtatgtgtatatatacatacatgtgtgtatacgcatatatacatatgtgtatatatacacgtatatacatgtgtgtatatatacacgtatatacgtgtgtatatacacacgtatatacatgtgtgtatatacatgtgtgtatatacacacgtatatacgtgtgtatatacacacgtatatacatgtgtgtatatacacacgtatatacatgtgtgtatatatacgtgtgtatatatataaacacatatatatatgcacatgcatatgtatacactgagttaagtagtataaatattttagagaaaattgatgtaaaatcctcaactcatttgatgctccctatcccaggacagtaaaaattgcccaatatttccttggacctccataaagaagcagtttttcaaaaaataaagtgtttggaagtttaagatgtgcctagcagtgtctccttttaacagagatgctttcacaaggatttgaatttccccattgagctgggaaccaggtttagccaagaacttcggtctgtgaaggactgcaaatagttgcacagtgtggggctgaggctagaacctccttaatattaaaccattctgggatggtgctccccaaattctggattttaaccttcactccaatcctggggcacctctgtagcttgggcatgacctggacacaagctttgtgtaagccttctttggacttcatccattcctcaacggtgacaccatgtggcagtgtaatataatggcatcagtggactcagatcctgttctctccctacctagagatttttaagattaagatatgtaattcacaaccataaaatgtaccaccttaaattgtacaatttattggtttttcatacattcaaaaagttgtacaaccaccaccattatctaattccataacattttcttcaccctagaaagaaacctcatacctattagcagccactccccaaactccccattctccccattcccccagtttctggggacccctaacctactttttgtttttatagatttgcctattctggacattttatataaatggaagcctacaatctatggccttttgtgtctggctccttttacttagtatgatcaaggttcatccaagttgtagcatgtaccagtacttcatttctttttatgtctgattaatgttccaatgtatggatataccacattttgtttatccattcaaaattgtggggcatttggattgttcccattttttttgctgtcataaataatgctgctaagtttttgtatgaacgtatgttttcaattctcttgggtatatatgtaaaagcagaattgctgggtcatatggtaactctgcatttaactttttggagttgaacaaatacaccatgccagcagtgaataaggatgctgatttcactatacctttgcacaatagttaagagcataaacactggaaccagatgtctgggttcgaatcccagctgtgctatctcctagctgtgtcgtttagacaagttactaaagctctgtgcctcagtgtccacatctctaaaatagaggcaataatagtaccttccttacaggattgttgtaagatttaaatgagctaatatgtgtaaatcacaaaaatagggtctgacattttttaaatggtatatgttttaccattgctgctattttaatctttattataattattgtgttttgttttgttaatttgatagctttaaaaggtaatgatacagtttattgatgtttgttatgaaaaggagtaattggagaagataaaaatgtaaggggtaataaagtcaaggaaggttttttgagctgaaaatgattatatttcagagtgtaacctgaataaaactgaggcttcacatggctcagtccatgcatgtaatagcattctaagaaaacataaactgaatgaaaacgtaaactgtgaagcatgaagaataatgagggtcttcaccttatgctttctgaaggagtccccgcaaatgcttcacacagcatattgaacaagaaactcctaaaatcttctctagatatttctctctttcctattttttcccactgacagtagcaccttatatctatcctcctcaactgcgaggtcactacagcactatactaagcccctgttaacttccttctcttgaaacccatgcaactcacatgatcctattctcagcctgtgaatctcagcctcctgcaatcctgtgaaattcaacttggtctcctactctgaatgtgtataaaaataacagagaacagttcctgaactctgatgagtaaaatgatctaccttattacatgtggtattataataaataaatatacattaatttctttccccattttccagcacacagctcctaaaagacttgtaacttcctgagtgataggtatgctaggtaaattttttgttctatgtgaccttcgactccagttcttgacacagagctcctgatcccttggaatttccatagtgataggagcatctttcattctcctgaagtaacttggtgggcttctggatgggagctggtcacaagaatgaccaagccatgattagaagcttggaactttcacctcctacctcatcctgtgaaaaggggagaggggctgaagattgaggtaacaattgctgatgtgtacatgatgaagtccccataaaaatccctaaatgaggggatttggagaggttctggaggtgctgaacgtggaggtgcttggagggtggcctatccagttcatctccagagttcacacactcacctaagtgctgatgcccacctgatggcatttctcagcctccgaggctttccttctttgtacttagtcaaaagaatgctctaatccagtctatcattgatgggcatttgggttggttccaagtctttgctattgtgaatagtgccgcaacaaacatacgtgtgcatgtgtctttatagtagcatgatttataatcctttgggtatatacccagtaatgagatcgctgggtcaaatggtatttctagttctagatccttgaggaattaccacactgtcttccacaatgcttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttgtctgatggccagtgatgatgagcattttttcatgtgtctgttggctacataaatgtcctcttttgagaaatgtctgttcatatccttcgcccactttgtgatgggattgtttttctcttgtaaatttgtttgagttctttgtagattctggatattagccctttgtcagatgagtagatagattaaggaaatatggcacatatacaccatggaatactatgcagccataaaaaaggatgagttcatgttctttgtaaggacatggatgaagctggaaaccatcattctcagcaaactattgcaaaaacaaaaaaccaaacaccgcgtgttctcactcataggtgggaattgaataatgagaacacttggacacatggtggggaacatcacacactggaacctgtcgtggggttgggggaggggggagggaaagcattaggagatatacctaatgtaaatgacgagttaatgggtgcagcacaccaacatggcacatgtatacatatgtaacaaacctgtacgttgtgcacatgcaccctagaacttaaagtataataaaaaaaaagaattctctaatccatggaataagtgttgaataatgaaattctgatattgtgtttaatgatatactgcactattcagaatatttgtacttaccttcgagtctctcttctaaaagatgccaaacccccttacacgaagtagaaaacgtcaaatatctaaatattgtatcttaataatgttcaaacattaaatgtttcaaatattccaatgtttagaatcataaaaaaaaaacataagaattgttttaaaaaaatgctctaaacttaacccacagcccttcttgtgaatttctccaaaataactggagcctggttaatagcaagcctcaggagcatggctttgaaatactgtcaacatactgccaccaatttctccatttccagaaaagactgtaattttttctttagaaatcatgattttcttgattggtttagactggtttccagtagttcacttaccaggaaagtttctgttttgtttttagacttccttaatttagagaatgcacataatattgaaactggctatagtatcctactctggaaaagcatattaaatacatacaaatatatatttaatgtatataaatacaaatatatatgtaatgtatataaatatatacaaatatatgtgtgtgtgagtatgtatcttccttgatttccttttatccattaccactaatatccctcaataagtcctactggttctacttccaaattatattttgaacatgctctacagaaacagctcctaaagattttccagcctccatgaatgtaagtcccctccatattccattcttcgtaccacagctagagtggtatttttagaacattcatcaggcaactaccctgctctaagccatctggtggcttttcattgcaagtagaatgcaacctctcccctagtcctcaaggctcttcatgatatgatttgaccctcccatccctcttcctcactctctacccacaattctcttcttttcatccttggaacttgccaagcttgttccacccgtatagtctttgtacctgtctcttcccatggccaaatatgctcttttggcagatctttccatggttatcttcatgattcatttctcagatatcacctcttacacatttcctgaccaccataactaaaggaacctcacacctgtgcactataccatattgctctgacttgtcttcttttttcttgtataggacttttcggtatctgaaatttttatttattaatttctgtttggaacatatctctctcagagcagaaaggtcttgctgtcctttcaaggaaatggtggggaaaagaaaaattctcattcttttatgatgagcctacaaaaataaatgggttaaatgggttcttgatccagttcaccttaagtgtggttaccaaaggaaatgattcacaaggtgactatttcatttgtgtgacactcacttatgttattagttctaggatattaaatcaagaaatattttctaggatcccctgaaagagtatctctcaattgtaaactttatctttagtggcattttgttgatttattgagattccctagatttaaaatatttaccacagagtgttccccaactcccacagcatttatccaggccataactacttatgtctggatttatgaacttattgtgggtgggggaaattgttggaggtctcatctttgttttaaagtacctgtggcatggggtctgccctttgaaggcaagagctcttcacctgcccagctcttccccagcttaggacaggaaggagagagacacagtgtgagcgagagaagcatctgattgtgagtgtcagatgaggacagctgctactctctggtcacccatacatgttaattacccctgtcatttaaaccattgttttgtgtaactagaacaaagtattctttccacgaagtctgtttgacacgagacacatataggatgtgagtctatgacaagggtaggggcaacaaatgtgaggggttggatggaaacagaggaagagaaatgagcattgcatagggcagtggtttaaaaccctacatgatcaaaaatagaacctggagacaaatcttgatattgtctttatacataataaaatgcattttaaaatattcgatgcaaacaaagcagtttgtcatgtcttttgttttgagtctctttagtatatgctgcttttgaagatcaagaacatttactggaaattgctccttcaccaggaatttgctcacatctcttcaggtccacttataagatcttgaaatcagtcctcctgagatcagtacaaacgaggatcatctctcctgctttagaagcaaaagtggcaagcagggtagacagaggcagaaggaaggatggtactgataaatcagccaaattagatggaagaaagcgaattacagctgtacttgcaaagaactcttggctcattttttcccttaaatattaaatcactagttttcaaaacttcaaatgtgaacatgactcacctgaggacaatgttaaaatgttgacctccaagaccctgcccccaagtttggatcccaggcagaaccctggaatctgtattttaaacattaaccccaagtcgagtgtaatgcaagtaaccatcagagacactctgagaaacagcacattggcaatgatgaatttatatgtctaaaaatgaatagagtagatgttacatgaataggaagtggtggtattcaagatgaccatagtatctagctcttcagccctggctccccactgctcttctcccatctcagcacttctccatctatttcgtccaaataaaaaaattcacacagagtttcaggacttaaccccccactcattaaccatctgttttgctttacatatttttctgaggtaataaaatttctctttttctaaacacagcctgtttttcaatctccgggtagttgatcaattgtatgggaaaatgaatggctgaagggtagaaacaggtgggaaagatgaacaaaaacacgaatcctcacattactaatacgcaaatcactgagcagcaagctgagcaaataccctcaattcccatcagcaactttagagaaaggcaaattccgtttgcctcattgatcatttaggtagaccctgaacactgctttcataaaacaaaaacaaaatacccatccccagtttaaaaaattattcatagatcatccaggccatctaggaggatatgatttaatcctggctacttggtaaattatttgcccaagttaactcagctagttagtggtagatggctctgaagccagttgtttttttttgttttgttttttgcagacctcaagagtcatgatgaactagcagatcataaagtttatgccctgggtcttgaccatttttagaaaaataaaacattaaatgaaaatatcagagggcattgcagatagtagatctaagtattttttcatgaaacttgttgtacatgtgtgtgtcatacacagactatatatatgcagtacctgtaaactgtattgccacataatgtctatattttcctagaggtcacagtcaccaaagttgggaagtcacccaacttcgggaactttgggaagtcacccaaacttacagtcaccaaaattgctctattctactatgtgacctcaaaagtgatttgaaagaaggaacatctgagctgggcccaaaccctattgcaattttattggggccaaagagaactccatgctcctgccaaatcaaggcagtgtcagcctcaataatttcccagataaaaataaaaatctgtgatacaatcagaatgtgaaaattcttattttggaagcaaatgtcataaccaatgcaagggctatctcaatattcattcattatgcagtattttgaactgcagttgaaatgaataagaaggaaaggcaaacaacgaagagtccaatttctcaatttagaaaaagagaaaaaaaagaaaagggagcacacaggcacggtggctcaagcctgtaatatcagcactttggcggatcacttgaggtcaaggagttcgagaaaagagagcacctagaagttcagcgcgggataatacttaagtaaattatgacaccatcgtctgtcatcttgggcccattcactaacccaaagctttcaaaagggctttcttaaccctcacctagaataggcttccgcagccttaatccttagggtggcagaatatcagggaccctgagcattcttaaaagatgtag

SEQ ID NO: 377 - DNA, 2719 bp, Homo sapiens
  cDNA VTCN1-203
ctggtaatctgtggcgtaacaagacctccaggtgattctctgtattagcagccgctctgtgctccctgattcctccagaaaagcacaaggatttaatccagatagatataaatttcacctgggatcatttatcattccacattcttctttaagaaatgtgctaaagagccacagatgggtcttgatgaaaacaaaggaaaagccatgaagtttctacagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacc

SEQ ID NO: 378 - DNA, 2637 bp, Homo sapiens
  cDNA VTCN1-001
acactatttaaggccaatacacgggagctggttgtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacc

SEQ ID NO: 379 - DNA, 2289 bp, Homo sapiens
  cDNA VTCN1-201
acactatttaaggccaatacacgggagctggttgtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacc

SEQ ID NO: 380 - DNA, 24482 bp, Homo sapiens
  Coding Sequence of the ADORA2A Gene
gtttatttattttttctttttttttttttggtagaaatgggcttttcgccatgttgcccaagctggtcttgcacttctgggctgaagcaatcctctcgccttggcctcccagagccttgggattacaggtgtgagtcactacagtgattgtgaatgcactgagctggcctggagaacacttaccaccttgtccacgtcacatgcaaaaggcccatggtggtggtgcttcctgcacacgagggcatgtagtgaatgcccttcccaggtggagactcctcagggttgggagcccagcaactgccttggccctgagtaagccaggagttgcactgtgacctgcaagtgcttgggagctgcacccctgggtgccaacagctgcaggtaccctggggtgggcagtgggcaacagctgtagagctgggagctgggcgtgaaaggactggggcaggactgggcttggactcagctcctccctgctcagcagccccttcgttgtgtcctctgctgtgcggaaggggttctgccctagtggtcagcaagcatccatggagcctgccgggcgggccctgtgtgcagcggcctccacacgtcagcaggggactgccgtccctgccagcgcacctgggccttgtcctgggcagcacagaccccttagccaccactcccaggtggggcggtcactcccagatcctccatccgtcccgcctgcagtgcagctgccttggatgctgattagggtggccctgaggggatccttctgtcccaagttacgggcctgcggggcccgtccacagtgctgtgcccctcaatttggagctggctctgctgcttcccagggcagcacctatggggagggcatcgtttataccttgactcaaagttccaggatctcagggacagcttaataggtggaagggggaagctgtgagattccagggagagtggagagattccagggagagtggagagattccagaaggatcccttacacccctccagcaccctcaagggcctgcggtcctgtgcccagacgccacgccctgccccagcagccctgcctggccagctctatggccccagccccacggggccggcacttcgtgcaacctcggggtagcctgggttctattttaggttgtcccttaggtgagggaccggggcagacagaaccagtctcaacatgctcgcagccacttccccgtacatcaggtgagtgaggacagactcctgggttgctgagattcggggatctggattctggcaggagctttgaccccaacaggtctggaccttactgggcatctacaggagctgggccgggcacaagagaggactccatctctcctgcctgacaggagaggactccacctgaccagccctctcaggctgggagtgcctcggggagcctgctgtgaggcagggggaggggtgcggagagaccgggcacagcttgccagttgactgcaccaggcccagagcaggtgctgaaaggtctggtcttttgtctgcaccctcccgtgtttgtgaggaaggggtggcagggggtctgcagtcttaagggccaagcagaaaagaagggccaaggcaggcacccaccaggcaggaagcaggtgtgccctgaggggaaggacaggccatcgcagggctgggttgcacccaagacttctgccaggaagagcactgaggagtcgggacacacaggtcctccccaggtcagccaccgacacttgggatgtgctgggcttgtttccacctctgcaaagcagggcccccttctgggccctcatatcaggcactctgacatggggtacagtcctggcaggtcatggggctggggccacagggagagcgggcaggtggcttagagccatcggggtgatgagtggcaagccccggcatgagggctgcagaggactgtcactgcccacgctggagccagggctccactcccctcagggcctgctttcacatctacgccgatcatccccaaggccgggttgctagcgggttgctgtttgtcctgacacccagaagcagatatggggtgaacatcttgagtggggtggggtgagttggaggatgatgaccagtgactcggagatcacttcctccgtatgtttcttctgcctttgcaggacctctgttaggataaactggagccttgtgaggtccctgccccattggagaagttggggagcacccagggtgacccagttggtttccagggacccttcccctgctcactggctgcttgtcctgggcctggcatgtcttgctcctgatgcagctcagctggcctcagagcaaacaatgagggccagaggccaccaggtgcatcctgggcaggaacaaagggccggaatcctggagctggggaggcccagctggccccgccgccgccgggcctgaggatctggagcctggatggaaggaagggtgggcgcccacagccttttcaaagcctgcctggggctgggcagggaaaccaacgcctggagccagaagctggggcctgccaggggcctccccgtgcccaccaaagggcagtggttgcaattggagagcttctgcccctcagccttgttgctcccttgggcctgggggtgggggaggcgggcagcccaggcacctgcacagggacctcccccagccccacagccttggtatctgaggacagcactcagctgaggtgggtacggggctggcaagggggcagcaaggccaagactgaggaggtggccttaaggcacgtggtgccgagaacacaggcccctccctggagaagacaagctggcttgtggggcaggcagtttggggacagccctgccaggtgccgttccccatccctgaactggacagcttggcctgtgccgtctctgggcaatggcagcgctggagacctgggccaaagcacctgacagatgacacaggaccgcggggctctctgcctctgaagggccagggaggagcccagtaggggaagggtgggggcctggcctgagccggcccatcacagcctccttggcactggctcctcatgggtggctgtggggactgtggagctggctctggggctggagccactccaggccctgcctgaccaccccctggcctcaggacacagttccaccggcgccactgctgaggaatggaggaactgccccttgagccctagaggtgaatgttaagggctttggcactgtgaccctgaggaccagctttggaacaaagccatcactccctgcgtgaggacgttgcggctgcaaccctcctgctgtgggactggggtgcacatggctagaccatgcatgggaaggtccacgcaggaaggttgcgggccccaggatgggaatggcagaggagtcattggggtccacactgggggacgagacagaccctcagaatcggctgagggctggtttctgcctcgtgagccccctgagcccctcaggaagactcaggacgctccgtgcatgtttgctgagtaagggcttgaatgaatctgggtccagcaggtgtgggcgggaggggtttgtccccactagaggagaggttttacctcgtggagagccccagaagcaaggatgggggggccaaggatggggccaagggagggccccatggccgtcagcatccctcacccctaccttgtggtttgacttaacctccaggagggggcagggcagacacaagatactcattttacaggtgaggatatgggtcctggaaggtctgcagggaagcccctgccgctggtcccagggcggtgtccccacctggagggggagctcctccactgaggaaagccagggccatgggagaaggcgagctcctttgaatagagggtcagcaaaggccaggatgacagagaggggggcaccagggccaggtctccttggaaagacctggggacagcgccccaagagtctcatgtgggtctcgcccttcggagtttaactcaagctgtctaggtccccacacatcccagggtttcctcctccaccttggacattagggaacacaaggaccaggagagccgggctagttgaatgggaacgggggcccaggcttcgatcccaggaataagccagggaggctgccagatgctcaaggctgcatctgggtaagcaatggtcactgccatgggccccatgcttctcctaacacactggccaggtgcctgtgtgcccatttcccacccaccctctcctccctgcagtgagtggtagctgctgtgatagaggtcatgcccccattctgccttcagccttagggtccagcctggccctgggcaagcccctccaccctgggcctctagccaggaccccactggtccccagaggttctagaatgcaaggattcccaaaagcctttggccaccaatgccccggctgtctgacatagcctgtcctgtcgtgaacagttgggattagtccacatccctccagatgcaagggtagaaggcgggtccccttggacagcttggagggctggacatgaagttgttcccagttggaagtctccagaaaataggcgagtggggcggggggatggggggggaattcccagcctcaggctctaaaattcccagttagtctgtggtgcagacaggactccctgcctccttgttcagggaagtaggggaggatcaaggccacactgggcaccaggagctggaagaacaagagggtctctggcccagagtctgggatggggagaggcagagggggcattggaaattggggacacatctttgaactgagataacagctgttgccaagaccagcacctgggccaggctaaggaagggcagggctaaaggtgggggagctaagggtcaggcagggccttgaacgccgtgttcaggaggctggcctttatccctcaggacctggggagccatggaaagatctgaggagcaggcattgggcacagctggacactggggaacgggtgacacaggggcatggatccagcccaactctgataaggaacagcagagttccacaggaccatagtggcagaggcagcagtgaggacttcttttttatttatttgtttgtttgagacagagtctagctctgtcccccaggctgcagtgcagtggcgtgatctcagctcactgcaacctccgcctcccgggttcaagcgattctcctgcctcagcctcccgagtagctgggactacaggcgcatgccaccacgcccggctaaattttgtacttttttagtagagacagggttttaccttgttagccaggatggtctcaatctcctgacctcgtggtccgcccacctccgcctcccaaagtgctgggattacaggcgtgagccaccgcgcccggccggcaatgggggcttcttaaaaaagagggaggctgggcccggtggttcacgcctgtaatcccagcactttgggaggccgaggcgggcggatcacgaggtcaggagttcgagaccagcctgaccaacatggtgaaacaccgtctctactaaaaaatacaaaagttagccgggcgtggtggcgggcgcctgtaatcccagctactcgggaggctgaggcaggagaatcgcttgaacccgggaggtggaggttgcagtgagccgagatcgcgccactgcactccagcctgggcgaaagaccaagagtccgtctcaaaaaaagaaaagagggagtgtgggggtggggcccggagcgctccaaggggcggggaaggggactcccaggcccgaggactcctggaagggaggtgagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtcagccggggtgctaggtctggcgtgcggggtcctgggtgccgggtccggggtgcggggtgccgggggtccggggctggtggccgggcggcgtggggccgtcgggggtgcggggccgggaggactgggaggctggggttctgctcccctcagggttcctttcccgccgccccgagaccagttccccggcgcggggtccgagtcctgccccgcggcggctgccggcactgcctgtgaagggcccaggcacagtcacgtcccaggcgcagttgcggcgccgcgtgcgggaccctccgagctgtcccaaactgcaccggaaggcgcgcaggggtaggcggggagggaaggcaagtgcggcggccggcgcggcgcggggtgcggagccgcaggtagcgggcggggagcgtccgtccgtcagtccgtccgtccgtccatgcgccgcagaccggccccgcgcgctcgcatgaaccttcgcgagctcctccagcagggatggaccgggggcgcagaggcgcttcctgaggggtggcgggccgggccccggggcgagggagattccccaggtggaggagccgggcggagaccggttccccgggaaggtgaggcgcgggcagagatacccgagcgcccgggacgcgccgagaaagggggaatcaggaacgctgggccgagcgctggcgtcttccgtggacagtggtggcgggaactgggtttgggggacccaggagacgacgggggacggatgggggtgggtgcgcgcctcggactggccccggccgtctgtctggctgcccggagcggaggtaggaatggcgggaatggtggcggctctcgagggatttggcgcaaggcggcccaagggcttgaggaggaggccgcgggccggcagagctgaggtccctgtgtcccgcactcagactttagttgccccgactgtaccatgggaggaagagggagacccagggctgggtcctaggctgggggagtcggggccctgcaaagacgcgcaggtgtttgtggcccttgttggagggtgagccgcaggtcaagccagccctccgtcgccatcctgaagcacctcctctcttgggctctgccacacacagggccttctcccctattgccaggtgctcaggccgcctccaccctgcctctgctgccggctccccctgggttccccggcggggcaccctgccgatactccatgacgcgccagggctgccccagggtgccccagccctggggaccatggtggagggttctgtggagcaccgcgggcctgggaagctgttgcggggtcggggcttcctcactggccctgctttggccgttcctggaggccttgggtggggctgggaaggccgggccctgtgggcagcaccccccccccccccgcccaacatcccggcagatccatggcaggggcgcctcacaggctggtccacggccacggtgtcagtccctccttgttctgcgcttgctttttggggtctcccagcctctccctagtcctagagtttctcaggcaaatcccagccactacccctccatccgtgtcccctgtttccccagtgctgagctggctgagctgtgagctttcctgctccttgcctcaggaagccaggggcagcccagtcacctctggccagaggcgggccttaggccaaggctgacctggctggtctgagagctgtgctgggcttcttcccatatcagtctgtgaattacagatccccaaatatgccctgcgtcgcgatggaggagggcaatcaatggcaatgactgcctcatgggcaacgcgatgtgctggagatttcagtgctctcgtctgggttctggtcttgcctcctcgacccactcgctgagcaggttgctgtcccggggaatctgatatctcatctgtagaacaaggatgatgatcttagcaatgcctaatgtggaaaggccttggcttgggagcaagtgggggaaggtttagggcagaccagagggccggtgaggggtgtgtgctggagcggggaacccgggagggagggtgttaggcttgagggtcaggggacaccacagggattgctgttggcagagggacatatgaatggtagttggcctgggagccagcatgtgacttgagagcatcacgtcctgcaaagtccaggtgaggcctgggcagtgcctgctgtgtgggaccacagcccctggtggctctcagctgtgtcctgacactccaaagaaggtcttagtaccctctcacagacctaatacccgagccacctaaccccaaatgagctagaactgccttcccaaccgtgtttgcggggtctgtcttgtctattgcagcgcaaacagagccctgagcacgcaggagagcagaggaaggacagacagaagatggatggatggatgaaggcgggaagcacaggctgaggggatttagggcatgtgtggtgggggtgctgtggagaggagactgcacaggcaggagctgagctggtgaatgggagggttctagctcccagaagggtctgggccattgacaggaggggcttggtcctaggaggtgggtggtccagaggttgcaaggagcagaggagcccagatggggaagggaatggagctggggtgcagagaggagcccccacacaactgcccacatcctgtgcagaacctggggctctgggtggtgggaagaggcagtttcatggcggaggaggcctgggcccctgcagcctggactccatggatctggccagggactggggaggatcaggtggagagaggagcagcagagcagctgcccctcgtcccagcacaggggatgatgggagcccagggaaggcaggaccctggcttcgggcattttctctgctagaatctctcgatacctctctcccttcaccttctcctccaagtctcacccagatgatgtttctgtgagttgccatggggattctctcaccaccccccgccaacaccccgcaggggaagcttgttccaggagtcactgggcaggggctgctgctgctcttctgtgcccactcctcggatgtgccgctgcagccctggtctctggcatcggccgtcacctggtggagaggctgccggagctggccaagcagagggaggccgatggtgccacttggtgtctcctctggcatctgggcaggagacttctccccagaggccccgggctggtctgcccgtgtcacaggaggactcgcctctggtccctcagtggcctctgcaaaccctgagccagcctgggggaggctgctcagtggggaagaagcagtggccaggctctgcttggtcaccctgccctcctgtcagcctccggggctgcctcgtcgcacctgcccagggacccaacagccggtcctcacccctcccatcctcattgcagccaccctggggcattgtgaggccctgcacccagcactgccccttcaagcctcccacagggtcccgcccaggactcctgggctctgtgtccgcggggccatctagaaacactcccttgtccccccttcagcggcatagtacctgttgcccgccatctgagggaggtgcaggtgccaatccttcacgtgacgtgacgtggctcaccacagcctgtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgaagcctcgtgtgagggggtgagtggcccccaggcggggaggagggggtgctgtggccttcctggcccctagcctggacacatgggggtgtggggagcaggagctggggcccccagcactggccccggggctgcgatgtgggggctgctctgtgaggcaggctcagagccttagcctccagctgcagggagctgggtcttggccccatcttgcccacatcctgccaccaggagcagagagctgcagctgcacccgggctgtgggggagggatgccaggtgtatctctgggtcccgggcccagcctgcacccagcgcctgaagtaagggccaccgggcagccccggaggtcaggagggaagtggagcccgtgctgggtggctgcttaccactgggcagtgaggaaggcacctgcgctgatgagtttggaaggggtatggggatcctggggccctgggttctgggaggttcatgcccaggcccccctgggccatcccaaaagccagtcatagtggggcccacaacctgccgtgccctgccgagctcccgcaagccacttgttgatgcttctcagtccaccccatgcctctcaaccgtttcctcctagactaggtctcttcatggcgtttctgggagaattcctcagtactagcttcagatccccagtcgtctcttccactgtacgtgtgcctgaagctcaccacatcccttacttcagtccttctatttttcagtccctggattttgtattatttcttgttcatatccacctgtccttgtttcatttccgccagtcggttcagaagttctcattcttgtctacggatgccattcctttctttgcctctttggagattctaaaggtctctgaaatcattattagattactgtattaccttccttcctactggaatgaattcacctccatgttttttattctgttgcttacctttcttagccttcatatacctcttgcgctttgaaattgatttgcgactcctcttagctgagccaatgttgtggagacagggagtggcctgcagtgcctgaaactgcagggcagcagccgcctcccaggaatgtcctgggtcctttcctcctttgaggtcccctgccatatgctcagatggggccaggcacagcaacgggggcacacctccctttggcccagcagttggggtgctgccaggcctggtggaggtacttggtaaacatttgttatggaaaagcagcaggagggttctaaggctgggattctggagcccaggaacaggccaggcatggctggagcgggtccgagtccgtgcactgtgtcctgtatgttgctcttagccgcactcaggagcagatgtgcaggtcactgcctagaagctggtgggcacctccgtgcagcaggctctggggggtatagccaccatctgggcatgtgtacagagggccttgctagtgcgacatatgaggaaccagaagatgtgtgggttttgattaaatggagttttaattaaagtggccaggttgggggaggtgaggaggaaggcaggaagcagcagcagttttgagtctgaccgcgtggaatcctataaggtggttctttcaagaggcattatgcacattccgcagcatgtgtcccctgtctgtatggggcagcatctgccctctgatctgtccccaacaaggggtaatcacagagaagtattacattattaatatttaatttcccctcctggttagcaacagatgactcaaggagtaattagatgcacagagccaacagagagggataggaaattgccagatcctggccccgccccctccccggggcctctgaccttcctgtcactctgggaggcttctgagggaggggagctggaggcccaggagccttcctgctgctgtgctctctgtgcgcacggccgcagccctacaccaccttccagtgctcttggtgaggctgagagaggtcgcttcgtgcctttgggcctcagtttcctcatctgtaaaatgggcttcctgggaccagcaagatcacagatgacagtcatttcccaagctcctaagcaggctgcacaagctgtgtctgagggtccagtgcagtgcctggcctctaggcaggtgccccctgggacgcgtaaggtttggcagctcagcagtgactggcatcgtggccagctgactctgtgttgctccccagttacggtccacgacacattagtagcttgaaactgggcacaaggggagaatttacaccacagaaatcaggcaaagcctgtaagtcagggtgcccccggccaggagctgatttgccagcctacggctgggtagctcccaacctttccccaatgaatgcactcctcttcccctgtctgccccaaaggtgcctctgactccactgatctgctttgctcagggccgagaaaggcacagctgagagtggattctggcttggcaggggcccaggttgcctgtgggtccgggcaagcctcacccgggatgtgctggcagcagctgggagagcctgcaggagtgcttaaggaggggctgagggagaggacgggcagcgaggtggcctgtgtggaccctgctggcaggagccgtgggtgtctttagccccgtgtgaggccggcctgggcagaggggtctgttgctgtcactgaggctggtgggcagcaggaaggtggcttcagtatagtcaagaaggttatcggtatctagtgctgtttagcatggggacccacagcacagaaggtggggagaccctgagaacgggggtacacaggcaggtacccagggctgccagggaagccttgccaaacagaggccctggtcaggcttctcccaaactgggcatcccagctggcatggcaccagtccagcccgtgaggcaggcgccgatgatttgaccccaccagcagggctctgggtgatgggactggggagtcctccttcactttggcagacgtgttatgttccaccttgtttgcccccagcaaggcccttgaatctggagcgtggtctggggctgcatcagccttctagcctgggatggtcagattggcagaaggctgtggcatccttcaatgcagatgccctagagagggccgtggtgggaggcaggatccctgggtagaggcggctcctcagtggcccactgggcctcactggacagtcgcctgttgctgctgctggtggtgctgggcctgggagtccaccttggagccacaggccaggcacctgggtgggaggcagcccggggccagcaccagctccacttgtacctgttgggcaggggctatcgtgagtcaggtgggccctggtgagtactgctcagggagagaggccaagagcatcagggataactgtgttccttgagtgtggccagggatggtgccaggagagctggtctggtgcatccctgccaacgacacactttgtgaatggctgcctggcaagtgctccatggaaagcaggggcttgggaggactcggccctctccagctgctgcaggccctccgttgctgcagggtttctggctctgctctctccttcctcctcctgcttctgtgtcaatgctccattcccaggctcctagtaggggcaaaagggcctgctgggtgcaggagaacctccagtcccaggtatggctgcagcccgtgccaatcctgttccagccacttgaggtgccgacagcattggagttggagggaaagttggggtctgtgtgtttgagctctgtcacatggacaatggggtagaggggagcctggccctttgaacagggctcaggaccaggagtgacttcctctccaggttgccagtcctgctccatccctcatgtcctggaagagagagagagacgaggtggctgcccgagtccacgtgaaaggcagcctctgacctcttgtccccaggcaggtggtggcggctggcaacacactcatagggccccatgagggttcaggattggagggggtagatttgggggcctcttagctctcaaagaggggcaatttaacgggcagaggtccatttggatccagaccattcacaggctcgaaggggacactgggagttggggctgggctcaggcctgctggggaaccaaaacttctgcttctgaggggtgtcagtaattccattttgactctgggggagccattttaaatctgtttatttccttctcatagaatcatgggtgagagctggcatggcccctagaggtcatttggggtccagctgcctcaccgtatcaatgaggaaactgaggcccagaaaagaaaagcatttttgcccagagtccctcagtgagtcctggttccgtacctgctttctgccagggaccaaactcccgttagtcattcctggtgtcagccaggcagaggagcaggtgggggagagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgggtgctggtagttcctgggagagttgacgggatggagcaggccaggggggctgagaagttggcctggcgagagaaggtgggtgggactgggagagcctgggcagggaggggcctttctgggagggagtgtcatggggctggccgagatccaggacccaggagactggccaagctgccacaggaggcctgagaggctgagcatgggggggccaacactgacagactttaacaagtttctggctcccccaggaaaaaaacagaccacatctgatccttggccctgagtccagagtgggaggcaccgtgacaacaatgcgcagagcagggaatgcagggagccatggatagtgctggggtgagctggagtcctggcaggggcccagctagggcagtactcattctgcagagcctgggagaaggggctgcctccttgggaggggtttgtgtgggagtctcagcgggaattctattggaccaggggaaccagccttgctcagtgacttctctgggtgtcctcctctaaagtgagggtcaaattcccacctctctcgcctcctggctatgaccacagcagaccaggcagggcatggggctaggcggggtcaggggccatcctcaggctgacacctggcctgtgggtagggtgggatctgaaactatagggtcttcagggggccaagtgtggggtaaggggtggcactttccgcagggctcgccctctgcagatggttcagcttctcatcggctgtccctttgcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtgagcagggccggggttacatctgtgcaaaggctgttggtgcccaggctttggtctgtgcccggagccagggtgagcctgggatcagggcctggtctgcagtgtcagcatggtgagctggcgacggggccccaggctcagcaggggctccccagggccagcacgtggccagcagtcatgccgaactgactgacccctatgggcgcagggcagcctggccctcccaggcggcctgggttcccctaggctgcctgaggccaactgtgctctgctttttggcagatgagtgtggccagggtctggcattgggcttagcagggagctgtggtcccagtgacccacgtgctgccagcgggtgtgtctgggccattcctcacacacaagcaaaacttcccggatgatgctggggtggagtggggagccaggggaaaccataggacctcagagttaggagccgcccgccacctgccttcccccagatcctctgggccagccttgcagtgtgcacattaggaaaatgacccagagaggggaagtgacttggttgaatgccacagtgagtcacttggacctatatgcaaattctgttgctcctcaagtcaccaaggactcatcgtcttagaggcagccagtgtgctcaggggctggctgttggaggggatttttatggtgaatcttttgtgaagtgacttcagccaagtaattgtgcaaatgaagattttcccagaggctgaattactcggcatggattccacctacccaggccatagatgaggctagaaagtgcatccctcccttggggacgtcagaggccttctgccccacctcctggcccctctgccacagagctgggttccacagcctgggtggttgtgggccctgaggccatgtatgaggcttgaggtggtgcctcttgagagtcagggagcagggtgcaccatctctgcggtgaattatctgaaactggtgggtgcctatctaaagaggaagccacagcaggttgagggtgccccagcaggaaggaggacccagctagatgagcaaatggaaatttagagcgtcaaagccaaggggcccttagaggtcatttcctctcatcttcgggatggaaaatgagcctcagagaagacagccagctgtttccgggccacacaacgagttggtagtggagctggggcgagtcctggaaagaaatgtggcctgatccccactgtgacttcagtcactggggagcggtcatgagcagcctgtctcgcagagcctgcaccaggtggctgtccctgtcacctgggctctaagtgggagcaggagctgcactgggctgctccagggaaggggaggaatctggacctcacactgccctgtcagatgctctctatcccaggagagtctagaaccctcggcaaaggagaaggggaccctggccagccctgagaggggtggaattagggattgtcggactccaagtgcagtctctggtgagcctccatccattgctctgcgacgggcagagcagagtttaggttcgtccagtggcagctcagaacacggaggcccaggaggggccctgtctgcaggtgcccaggtgggccagagaacaaagcactggaggggacttcagggaaccaagctgagtctgcacactgatgggatgctctatggggaagcagaggccaagctctcacttttttctctgattcaaagggtatgatcagggctgccgttctcaatttaaaggagctcgactttttttctcttttgtctctccctttccttctctgttttctgagagttgagagaatgactccctatgtagtaggacaggatgtgctgtgtggctatggaaagttagctgcctctctctgggcccatttcctcatccataaaataggacaagtctctctgcccctctgagctcacaaaggtgttctgaaggtccagtgagtggatggggtgacagggaccctgaggagggttggaggcgtggggagggtggggattcagatctttgggttcagagccatggacctgccccctatcctctacccatctcatcccaacttccttggagctggaccttagttccacccagaccttgagccatttgactctgctccatgaggctctgcaaggcttaggctggtctcttctgcagggggccctggagaggatgacgacgatgatgttcatcctcccttgagggcagagagctttgcagttgccaaaggatgtcagctcagcatctcctgtcatcctcttggcctgcattgtggccaggcggatgttctgaccctcctgttactcacaaactcatggggaggccagagcagggaaggacatacgagtgtctcctgatgtggatggactccagggcccttcaggctgttcctggcccgcaggtcccttcgctttcctgttcctcagggcccctgggcctctgggcatgtggaggtgtccatgtgggctcccgagagcaagcggggtatgaaaggaacttggtgacactcctggccggcgctggagtcacagcctgcctcaggatcctccctcctcctttctcagctgggaatccagcctcctctacgtgccgtttcctgctccactcagaaaggtccattcggctagccctgggtctagcctcaggcctgccccactctccattaactttttttttaaaaaaaagaactcagttttggaaaaatctgttattttccaagttcagggaacctgttgggctagcacagggcctagtcgaggaactctgtgagaaagacttcaggccagaggcagagatgtagctctctgtgttcccagaggatagggaattcagggtgagagacacaggcttctttttccagttcccaggggatttttgcctcactgtcccctccctggctctcacagcagcccttggtggatgttctcgctggtttgaggaacaggccaaggtgcaggtggcagctggtggtgaggcccgaagtcctaacacttctaagagggcaggattgggagagagggctccctggaggaggtgtcacccagtgggtcttgcaggacgggcaggcagggtctcactggcatgagtgtgggggcaggtgtgtcaggaggggggcaaagcctgggacaagaccctgaggaaggaatgagcatgtgagcactgggtagggaagggtggcctggctgcctagtgacagagagagatgaacagagtgggcaggaaaggtggaggccaagtcaggcctgttcgtaccaggggaaggaatggaggtttccctgtgggtccatggctcttcaattcttggatcaatgactcctttggacaacttaggaaggctccacctactcctcaggttgggacatgtgcacataaagccccagctggaatcatggggcatattcttggaccatagggtgagcccccagtgtgggtaatggagatccccagaaaggggcagcctgcaagccgggggacacagagctgcagagggcacctccacaaagggtgggcagcagctctgggacccacattctctgacatgcctgggcaccccagagtggtggtgtgtcacgctagacagccttggcatcccttccagctggatggtcaatgtttggggtctaagacggcaagatgtgagtgtgttggtcacagatgcagcccaggatatgctgctgggcctggctgaggctcagctgtgattccatttgggccctgatgctgtccccaccccgtgggcaccagggtccagggctctcagcctatggagatttcttttgaataaacttagtctatttgcaatttaagaaaaaaaaaagtcatgttttgcccactctaaaacattaaaaaggaacaaaagagtatagtatagtagaaagttgtcctccataccccctgtcccccaccctcagttccctgcctgcaaggccatgttaagaatccttccagagatattctttgcatatataagcaagtgctattaatgtatgttttgtttctgtccccacacgggactttctttgcagagtacggtggaagactccccttgtgggttcccttttctgtacaagtcaacaattggacagaccagggatttccatactgtgttcccagaagccttcgggttggctctggtgtccccaccaattcactgattcaataaacatttaataagccccttcccttccccagcagcttcacctctgtgactgcctgggaatgtgggcgacaaggtttgctgctgagaacagtttgaaaaccagcaaagcaggtggcccagggcccaggcagctctgcaacacccctgtggctgcttggctctgctctgttgcctcaaatgacaggaaactcactattgcctgaggcaggccatctctcctgtgaacagctcagctgaaaaactcttaacctaccctgagttacaatctgcctccctataatttccacccactgattctccattctgcccttagagggcagagtgctgacaggtccacgacttggtcccattttacaaatgaagaaactgaggctcagagagacaaagttttaaaacattcctgttaacagggccagaacccaggaagggatatgcttttctcaggaataatgtcaaaattaatatagcttcccagtcaatgaggactatataaattactatttgcaaagcactaagaacagtgtccggcacagagtcagtgctatgtaatgtagatgtgagaatgagagagcctgagattttatgtttgcgagtcccacaggaggcagggcaatgccaactccctgttgcttggaagcaatgggcaagtctatgaccctcctgttgaggccctgttacaggtaaccaagcccccacggaatggagctgaggagctcctgagaatgggcttgtccggttactgtttggattcagaactgacctaagagattcagaacagacagactcgccttggcctgagttgcctctgggctcttggaatgtccacagcaagtccattcctctccttgggcctcaatttacccacctgtaaaacaagaggattggaccacataagagatcggaagccaccagggtttctctttttctcttttatttgaattagttgacaaaacttaaatcttgggagattttacccagaaaatcatctccccagccccacctgagatctggtaatagcaggcgtacgttttgcatggcgctgaagaccaggtaaacgccccaccagctgcctcctgtgtgtgctacctataggcgcctgtttgctacccgtgaatgagatggtttctgtggatgttcccagctccgcagttaagtagagcacatccttccccttgcacctttttttttttttttttttttttttttttggagactgagtcttgctctgtctcccaggctggagtgcagtggcgcgatcttggctcactgcaagctctgcctcctgggttcacaccattctcctgcctgtctcccaagtagctgggattacaggcccccgccaccacggccggctagttttttttatttttagtagagacaaggtttctccatctcctgacctcgtgatccgcctgcctcggcctcccaaagtgctgggattacaggtgtgagccactgcgcccggcctccttgcaccttctgagtgtccctgtctcggagctggcaatgcagagatggatgtaggaaagccctgcccccgaggggcccagatgtggtggggatctgctgcacttcggtaggaaacttctttgagatctctatcctggacttgaaggatgggtagggtttctgccaggtagaggggagtgtagtctggtcttgccagaatcaaaactgttaaacagaagtcatccctcagtgatcatcaaggttgccttcctaaattagggagactttttttttttattgtccattctttcatgaaatctaggccacctttcctacagggctgaggtctgcttactggctggcagatccagccatttcccgagtatgagactgggagtcggtaggcttggatttctgtctggctctcactcaggaagactgagtgatttcgggcagattactgtccccctggacctcagtatttccttgcaaatgttaagatggccatgtaaatgttaacaagtaattctctcatttctctccagagggctgtgggtgggtttggaggggagaaatggcatctcctttggcctgggacctcctcccctcttttaccctccatgctgcctctcctcaagggcttctggagtccccaagtcaaatggcaaatggggaagagaagacagggtatggagtacaagaggcctagatcctctataggtctgatctggctggtgctgcccctagccagtaaagccaccctccagaccccttcaagcctgttgtagccttaaccaagatcaaccaacatggaggtgactgatcttggttaaggctgcgaccaacatggaggtaattgatcttggttaaggctacgacacgtttccctttagagaaaaatcatgttttccccctcaaaaaatcatgcgttaatttcctccaaccaaactaagtcccaggactactccgaaaactactcaatgaccatctgggcatttgtacatgggtttccatttcttggatgcctgctctcctgttacctcccagaagcctgtgaaaaaggcaaggcatattacttccacttaacggaagaggatgctggggcgaggtggcaggaaatgactggtccaagaccttacagtcaggaaatgtggaaacgggtgctgctctggggttctgaactcttggccctgcttaaccctggcttctcagatctctgatgctggtctcttctccccaggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaa

SEQ ID NO: 381 - DNA, 12112 bp, Homo sapiens
  1st Promoter and CpG Island of ADORA2A
agcttggagggctggacatgaagttgttcccagttggaagtctccagaaaataggcgagtggggcggggggatggggggggaattcccagcctcaggctctaaaattcccagttagtctgtggtgcagacaggactccctgcctccttgttcagggaagtaggggaggatcaaggccacactgggcaccaggagctggaagaacaagagggtctctggcccagagtctgggatggggagaggcagagggggcattggaaattggggacacatctttgaactgagataacagctgttgccaagaccagcacctgggccaggctaaggaagggcagggctaaaggtgggggagctaagggtcaggcagggccttgaacgccgtgttcaggaggctggcctttatccctcaggacctggggagccatggaaagatctgaggagcaggcattgggcacagctggacactggggaacgggtgacacaggggcatggatccagcccaactctgataaggaacagcagagttccacaggaccatagtggcagaggcagcagtgaggacttcttttttatttatttgtttgtttgagacagagtctagctctgtcccccaggctgcagtgcagtggcgtgatctcagctcactgcaacctccgcctcccgggttcaagcgattctcctgcctcagcctcccgagtagctgggactacaggcgcatgccaccacgcccggctaaattttgtacttttttagtagagacagggttttaccttgttagccaggatggtctcaatctcctgacctcgtggtccgcccacctccgcctcccaaagtgctgggattacaggcgtgagccaccgcgcccggccggcaatgggggcttcttaaaaaagagggaggctgggcccggtggttcacgcctgtaatcccagcactttgggaggccgaggcgggcggatcacgaggtcaggagttcgagaccagcctgaccaacatggtgaaacaccgtctctactaaaaaatacaaaagttagccgggcgtggtggcgggcgcctgtaatcccagctactcgggaggctgaggcaggagaatcgcttgaacccgggaggtggaggttgcagtgagccgagatcgcgccactgcactccagcctgggcgaaagaccaagagtccgtctcaaaaaaagaaaagagggagtgtgggggtggggcccggagcgctccaaggggcggggaaggggactcccaggcccgaggactcctggaagggaggtgagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtcagccggggtgctaggtctggcgtgcggggtcctgggtgccgggtccggggtgcggggtgccgggggtccggggctggtggccgggcggcgtggggccgtcgggggtgcggggccgggaggactgggaggctggggttctgctcccctcagggttcctttcccgccgccccgagaccagttccccggcgcggggtccgagtcctgccccgcggcggctgccggcactgcctgtgaagggcccaggcacagtcacgtcccaggcgcagttgcggcgccgcgtgcgggaccctccgagctgtcccaaactgcaccggaaggcgcgcaggggtaggcggggagggaaggcaagtgcggcggccggcgcggcgcggggtgcggagccgcaggtagcgggcggggagcgtccgtccgtcagtccgtccgtccgtccatgcgccgcagaccggccccgcgcgctcgcatgaaccttcgcgagctcctccagcagggatggaccgggggcgcagaggcgcttcctgaggggtggcgggccgggccccggggcgagggagattccccaggtggaggagccgggcggagaccggttccccgggaaggtgaggcgcgggcagagatacccgagcgcccgggacgcgccgagaaagggggaatcaggaacgctgggccgagcgctggcgtcttccgtggacagtggtggcgggaactgggtttgggggacccaggagacgacgggggacggatgggggtgggtgcgcgcctcggactggccccggccgtctgtctggctgcccggagcggaggtaggaatggcgggaatggtggcggctctcgagggatttggcgcaaggcggcccaagggcttgaggaggaggccgcgggccggcagagctgaggtccctgtgtcccgcactcagactttagttgccccgactgtaccatgggaggaagagggagacccagggctgggtcctaggctgggggagtcggggccctgcaaagacgcgcaggtgtttgtggcccttgttggagggtgagccgcaggtcaagccagccctccgtcgccatcctgaagcacctcctctcttgggctctgccacacacagggccttctcccctattgccaggtgctcaggccgcctccaccctgcctctgctgccggctccccctgggttccccggcggggcaccctgccgatactccatgacgcgccagggctgccccagggtgccccagccctggggaccatggtggagggttctgtggagcaccgcgggcctgggaagctgttgcggggtcggggcttcctcactggccctgctttggccgttcctggaggccttgggtggggctgggaaggccgggccctgtgggcagcaccccccccccccccgcccaacatcccggcagatccatggcaggggcgcctcacaggctggtccacggccacggtgtcagtccctccttgttctgcgcttgctttttggggtctcccagcctctccctagtcctagagtttctcaggcaaatcccagccactacccctccatccgtgtcccctgtttccccagtgctgagctggctgagctgtgagctttcctgctccttgcctcaggaagccaggggcagcccagtcacctctggccagaggcgggccttaggccaaggctgacctggctggtctgagagctgtgctgggcttcttcccatatcagtctgtgaattacagatccccaaatatgccctgcgtcgcgatggaggagggcaatcaatggcaatgactgcctcatgggcaacgcgatgtgctggagatttcagtgctctcgtctgggttctggtcttgcctcctcgacccactcgctgagcaggttgctgtcccggggaatctgatatctcatctgtagaacaaggatgatgatcttagcaatgcctaatgtggaaaggccttggcttgggagcaagtgggggaaggtttagggcagaccagagggccggtgaggggtgtgtgctggagcggggaacccgggagggagggtgttaggcttgagggtcaggggacaccacagggattgctgttggcagagggacatatgaatggtagttggcctgggagccagcatgtgacttgagagcatcacgtcctgcaaagtccaggtgaggcctgggcagtgcctgctgtgtgggaccacagcccctggtggctctcagctgtgtcctgacactccaaagaaggtcttagtaccctctcacagacctaatacccgagccacctaaccccaaatgagctagaactgccttcccaaccgtgtttgcggggtctgtcttgtctattgcagcgcaaacagagccctgagcacgcaggagagcagaggaaggacagacagaagatggatggatggatgaaggcgggaagcacaggctgaggggatttagggcatgtgtggtgggggtgctgtggagaggagactgcacaggcaggagctgagctggtgaatgggagggttctagctcccagaagggtctgggccattgacaggaggggcttggtcctaggaggtgggtggtccagaggttgcaaggagcagaggagcccagatggggaagggaatggagctggggtgcagagaggagcccccacacaactgcccacatcctgtgcagaacctggggctctgggtggtgggaagaggcagtttcatggcggaggaggcctgggcccctgcagcctggactccatggatctggccagggactggggaggatcaggtggagagaggagcagcagagcagctgcccctcgtcccagcacaggggatgatgggagcccagggaaggcaggaccctggcttcgggcattttctctgctagaatctctcgatacctctctcccttcaccttctcctccaagtctcacccagatgatgtttctgtgagttgccatggggattctctcaccaccccccgccaacaccccgcaggggaagcttgttccaggagtcactgggcaggggctgctgctgctcttctgtgcccactcctcggatgtgccgctgcagccctggtctctggcatcggccgtcacctggtggagaggctgccggagctggccaagcagagggaggccgatggtgccacttggtgtctcctctggcatctgggcaggagacttctccccagaggccccgggctggtctgcccgtgtcacaggaggactcgcctctggtccctcagtggcctctgcaaaccctgagccagcctgggggaggctgctcagtggggaagaagcagtggccaggctctgcttggtcaccctgccctcctgtcagcctccggggctgcctcgtcgcacctgcccagggacccaacagccggtcctcacccctcccatcctcattgcagccaccctggggcattgtgaggccctgcacccagcactgccccttcaagcctcccacagggtcccgcccaggactcctgggctctgtgtccgcggggccatctagaaacactcccttgtccccccttcagcggcatagtacctgttgcccgccatctgagggaggtgcaggtgccaatccttcacgtgacgtgacgtggctcaccacagcctgtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgaagcctcgtgtgagggggtgagtggcccccaggcggggaggagggggtgctgtggccttcctggcccctagcctggacacatgggggtgtggggagcaggagctggggcccccagcactggccccggggctgcgatgtgggggctgctctgtgaggcaggctcagagccttagcctccagctgcagggagctgggtcttggccccatcttgcccacatcctgccaccaggagcagagagctgcagctgcacccgggctgtgggggagggatgccaggtgtatctctgggtcccgggcccagcctgcacccagcgcctgaagtaagggccaccgggcagccccggaggtcaggagggaagtggagcccgtgctgggtggctgcttaccactgggcagtgaggaaggcacctgcgctgatgagtttggaaggggtatggggatcctggggccctgggttctgggaggttcatgcccaggcccccctgggccatcccaaaagccagtcatagtggggcccacaacctgccgtgccctgccgagctcccgcaagccacttgttgatgcttctcagtccaccccatgcctctcaaccgtttcctcctagactaggtctcttcatggcgtttctgggagaattcctcagtactagcttcagatccccagtcgtctcttccactgtacgtgtgcctgaagctcaccacatcccttacttcagtccttctatttttcagtccctggattttgtattatttcttgttcatatccacctgtccttgtttcatttccgccagtcggttcagaagttctcattcttgtctacggatgccattcctttctttgcctctttggagattctaaaggtctctgaaatcattattagattactgtattaccttccttcctactggaatgaattcacctccatgttttttattctgttgcttacctttcttagccttcatatacctcttgcgctttgaaattgatttgcgactcctcttagctgagccaatgttgtggagacagggagtggcctgcagtgcctgaaactgcagggcagcagccgcctcccaggaatgtcctgggtcctttcctcctttgaggtcccctgccatatgctcagatggggccaggcacagcaacgggggcacacctccctttggcccagcagttggggtgctgccaggcctggtggaggtacttggtaaacatttgttatggaaaagcagcaggagggttctaaggctgggattctggagcccaggaacaggccaggcatggctggagcgggtccgagtccgtgcactgtgtcctgtatgttgctcttagccgcactcaggagcagatgtgcaggtcactgcctagaagctggtgggcacctccgtgcagcaggctctggggggtatagccaccatctgggcatgtgtacagagggccttgctagtgcgacatatgaggaaccagaagatgtgtgggttttgattaaatggagttttaattaaagtggccaggttgggggaggtgaggaggaaggcaggaagcagcagcagttttgagtctgaccgcgtggaatcctataaggtggttctttcaagaggcattatgcacattccgcagcatgtgtcccctgtctgtatggggcagcatctgccctctgatctgtccccaacaaggggtaatcacagagaagtattacattattaatatttaatttcccctcctggttagcaacagatgactcaaggagtaattagatgcacagagccaacagagagggataggaaattgccagatcctggccccgccccctccccggggcctctgaccttcctgtcactctgggaggcttctgagggaggggagctggaggcccaggagccttcctgctgctgtgctctctgtgcgcacggccgcagccctacaccaccttccagtgctcttggtgaggctgagagaggtcgcttcgtgcctttgggcctcagtttcctcatctgtaaaatgggcttcctgggaccagcaagatcacagatgacagtcatttcccaagctcctaagcaggctgcacaagctgtgtctgagggtccagtgcagtgcctggcctctaggcaggtgccccctgggacgcgtaaggtttggcagctcagcagtgactggcatcgtggccagctgactctgtgttgctccccagttacggtccacgacacattagtagcttgaaactgggcacaaggggagaatttacaccacagaaatcaggcaaagcctgtaagtcagggtgcccccggccaggagctgatttgccagcctacggctgggtagctcccaacctttccccaatgaatgcactcctcttcccctgtctgccccaaaggtgcctctgactccactgatctgctttgctcagggccgagaaaggcacagctgagagtggattctggcttggcaggggcccaggttgcctgtgggtccgggcaagcctcacccgggatgtgctggcagcagctgggagagcctgcaggagtgcttaaggaggggctgagggagaggacgggcagcgaggtggcctgtgtggaccctgctggcaggagccgtgggtgtctttagccccgtgtgaggccggcctgggcagaggggtctgttgctgtcactgaggctggtgggcagcaggaaggtggcttcagtatagtcaagaaggttatcggtatctagtgctgtttagcatggggacccacagcacagaaggtggggagaccctgagaacgggggtacacaggcaggtacccagggctgccagggaagccttgccaaacagaggccctggtcaggcttctcccaaactgggcatcccagctggcatggcaccagtccagcccgtgaggcaggcgccgatgatttgaccccaccagcagggctctgggtgatgggactggggagtcctccttcactttggcagacgtgttatgttccaccttgtttgcccccagcaaggcccttgaatctggagcgtggtctggggctgcatcagccttctagcctgggatggtcagattggcagaaggctgtggcatccttcaatgcagatgccctagagagggccgtggtgggaggcaggatccctgggtagaggcggctcctcagtggcccactgggcctcactggacagtcgcctgttgctgctgctggtggtgctgggcctgggagtccaccttggagccacaggccaggcacctgggtgggaggcagcccggggccagcaccagctccacttgtacctgttgggcaggggctatcgtgagtcaggtgggccctggtgagtactgctcagggagagaggccaagagcatcagggataactgtgttccttgagtgtggccagggatggtgccaggagagctggtctggtgcatccctgccaacgacacactttgtgaatggctgcctggcaagtgctccatggaaagcaggggcttgggaggactcggccctctccagctgctgcaggccctccgttgctgcagggtttctggctctgctctctccttcctcctcctgcttctgtgtcaatgctccattcccaggctcctagtaggggcaaaagggcctgctgggtgcaggagaacctccagtcccaggtatggctgcagcccgtgccaatcctgttccagccacttgaggtgccgacagcattggagttggagggaaagttggggtctgtgtgtttgagctctgtcacatggacaatggggtagaggggagcctggccctttgaacagggctcaggaccaggagtgacttcctctccaggttgccagtcctgctccatccctcatgtcctggaagagagagagagacgaggtggctgcccgagtccacgtgaaaggcagcctctgacctcttgtccccaggcaggtggtggcggctggcaacacactcatagggccccatgagggttcaggattggagggggtagatttgggggcctcttagctctcaaagaggggcaatttaacgggcagaggtccatttggatccagaccattcacaggctcgaaggggacactgggagttggggctgggctcaggcctgctggggaaccaaaacttctgcttctgaggggtgtcagtaattccattttgactctgggggagccattttaaatctgtttatttccttctcatagaatcatgggtgagagctggcatggcccctagaggtcatttggggtccagctgcctcaccgtatcaatgaggaaactgaggcccagaaaagaaaagcatttttgcccagagtccctcagtgagtcctggttccgtacctgctttctgccagggaccaaactcccgttagtcattcctggtgtcagccaggcagaggagcaggtgggggagagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgggtgctggtagttcctgggagagttgacgggatggagcaggccaggggggctgagaagttggcctggcgagagaaggtgggtgggactgggagagcctgggcagggaggggcctttctgggagggagtgtcatggggctggccgagatccaggacccaggagactggccaagctgccacaggaggcctgagaggctgagcatgggggggccaacactgacagactttaacaagtttctggctcccccaggaaaaaaacagaccacatctgatccttggccctgagtccagagtgggaggcaccgtgacaacaatgcgcagagcagggaatgcagggagccatggatagtgctggggtgagctggagtcctggcaggggcccagctagggcagtactcattctgcagagcctgggagaaggggctgcctccttgggaggggtttgtgtgggagtctcagcgggaattctattggaccaggggaaccagccttgctcagtgacttctctgggtgtcctcctctaaagtgagggtcaaattcccacctctctcgcctcctggctatgaccacagcagaccaggcagggcatggggctaggcggggtcaggggccatcctcaggctgacacctggcctgtgggtagggtgggatctgaaactatagggtcttcagggggccaagtgtggggtaaggggtggcactttccgcagggctcgccctctgcagatggttcagcttctcatcggctgtccctttgcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtgagcagggccggggttacatctgtgcaaaggctgttggtgcccaggctttggtctgtgcccggagccagggtgagcctgggatcagggcctggtctgcagtgtcagcatggtgagctggcgacggggccccaggctcagcaggggctccccagggccagcacgtggccagcagtcatgccgaactgactgacccctatgggcgcagggcagcctggccctcccaggcggcctgggttcccctaggctgcctgaggccaactgtgctctgctttttggcagatgagtgtggccagggtctggcattgggcttagcagggagctgtggtcccagtgacccacgtgctgccagcgggtgtgtctgggccattcctcacacacaagcaaaacttcccggatgatgctggggtggagtggggagccaggggaaaccataggacctcagagttaggagccgcccgccacctgccttcccccagatcctctgggccagccttgcagtgtgcacattaggaaaatgacccagagaggggaagtgacttggttgaatgccacagtgagtcacttggacctatatgcaaattctgttgctcctcaagtcaccaaggactcatcgtcttagaggcagccagtgtgctcaggggctggctgttggaggggatttttatggtgaatcttttgtgaagtgacttcagccaagtaattgtgcaaatgaagattttcccagaggctg

SEQ ID NO: 382 - DNA, 4917 bp, Homo sapiens
  1st Enhancer of ADORA2A
gtcccgcctgcagtgcagctgccttggatgctgattagggtggccctgaggggatccttctgtcccaagttacgggcctgcggggcccgtccacagtgctgtgcccctcaatttggagctggctctgctgcttcccagggcagcacctatggggagggcatcgtttataccttgactcaaagttccaggatctcagggacagcttaataggtggaagggggaagctgtgagattccagggagagtggagagattccagggagagtggagagattccagaaggatcccttacacccctccagcaccctcaagggcctgcggtcctgtgcccagacgccacgccctgccccagcagccctgcctggccagctctatggccccagccccacggggccggcacttcgtgcaacctcggggtagcctgggttctattttaggttgtcccttaggtgagggaccggggcagacagaaccagtctcaacatgctcgcagccacttccccgtacatcaggtgagtgaggacagactcctgggttgctgagattcggggatctggattctggcaggagctttgaccccaacaggtctggaccttactgggcatctacaggagctgggccgggcacaagagaggactccatctctcctgcctgacaggagaggactccacctgaccagccctctcaggctgggagtgcctcggggagcctgctgtgaggcagggggaggggtgcggagagaccgggcacagcttgccagttgactgcaccaggcccagagcaggtgctgaaaggtctggtcttttgtctgcaccctcccgtgtttgtgaggaaggggtggcagggggtctgcagtcttaagggccaagcagaaaagaagggccaaggcaggcacccaccaggcaggaagcaggtgtgccctgaggggaaggacaggccatcgcagggctgggttgcacccaagacttctgccaggaagagcactgaggagtcgggacacacaggtcctccccaggtcagccaccgacacttgggatgtgctgggcttgtttccacctctgcaaagcagggcccccttctgggccctcatatcaggcactctgacatggggtacagtcctggcaggtcatggggctggggccacagggagagcgggcaggtggcttagagccatcggggtgatgagtggcaagccccggcatgagggctgcagaggactgtcactgcccacgctggagccagggctccactcccctcagggcctgctttcacatctacgccgatcatccccaaggccgggttgctagcgggttgctgtttgtcctgacacccagaagcagatatggggtgaacatcttgagtggggtggggtgagttggaggatgatgaccagtgactcggagatcacttcctccgtatgtttcttctgcctttgcaggacctctgttaggataaactggagccttgtgaggtccctgccccattggagaagttggggagcacccagggtgacccagttggtttccagggacccttcccctgctcactggctgcttgtcctgggcctggcatgtcttgctcctgatgcagctcagctggcctcagagcaaacaatgagggccagaggccaccaggtgcatcctgggcaggaacaaagggccggaatcctggagctggggaggcccagctggccccgccgccgccgggcctgaggatctggagcctggatggaaggaagggtgggcgcccacagccttttcaaagcctgcctggggctgggcagggaaaccaacgcctggagccagaagctggggcctgccaggggcctccccgtgcccaccaaagggcagtggttgcaattggagagcttctgcccctcagccttgttgctcccttgggcctgggggtgggggaggcgggcagcccaggcacctgcacagggacctcccccagccccacagccttggtatctgaggacagcactcagctgaggtgggtacggggctggcaagggggcagcaaggccaagactgaggaggtggccttaaggcacgtggtgccgagaacacaggcccctccctggagaagacaagctggcttgtggggcaggcagtttggggacagccctgccaggtgccgttccccatccctgaactggacagcttggcctgtgccgtctctgggcaatggcagcgctggagacctgggccaaagcacctgacagatgacacaggaccgcggggctctctgcctctgaagggccagggaggagcccagtaggggaagggtgggggcctggcctgagccggcccatcacagcctccttggcactggctcctcatgggtggctgtggggactgtggagctggctctggggctggagccactccaggccctgcctgaccaccccctggcctcaggacacagttccaccggcgccactgctgaggaatggaggaactgccccttgagccctagaggtgaatgttaagggctttggcactgtgaccctgaggaccagctttggaacaaagccatcactccctgcgtgaggacgttgcggctgcaaccctcctgctgtgggactggggtgcacatggctagaccatgcatgggaaggtccacgcaggaaggttgcgggccccaggatgggaatggcagaggagtcattggggtccacactgggggacgagacagaccctcagaatcggctgagggctggtttctgcctcgtgagccccctgagcccctcaggaagactcaggacgctccgtgcatgtttgctgagtaagggcttgaatgaatctgggtccagcaggtgtgggcgggaggggtttgtccccactagaggagaggttttacctcgtggagagccccagaagcaaggatgggggggccaaggatggggccaagggagggccccatggccgtcagcatccctcacccctaccttgtggtttgacttaacctccaggagggggcagggcagacacaagatactcattttacaggtgaggatatgggtcctggaaggtctgcagggaagcccctgccgctggtcccagggcggtgtccccacctggagggggagctcctccactgaggaaagccagggccatgggagaaggcgagctcctttgaatagagggtcagcaaaggccaggatgacagagaggggggcaccagggccaggtctccttggaaagacctggggacagcgccccaagagtctcatgtgggtctcgcccttcggagtttaactcaagctgtctaggtccccacacatcccagggtttcctcctccaccttggacattagggaacacaaggaccaggagagccgggctagttgaatgggaacgggggcccaggcttcgatcccaggaataagccagggaggctgccagatgctcaaggctgcatctgggtaagcaatggtcactgccatgggccccatgcttctcctaacacactggccaggtgcctgtgtgcccatttcccacccaccctctcctccctgcagtgagtggtagctgctgtgatagaggtcatgcccccattctgccttcagccttagggtccagcctggccctgggcaagcccctccaccctgggcctctagccaggaccccactggtccccagaggttctagaatgcaaggattcccaaaagcctttggccaccaatgccccggctgtctgacatagcctgtcctgtcgtgaacagttgggattagtccacatccctccagatgcaagggtagaaggcgggtccccttggacagcttggagggctggacatgaagttgttcccagttggaagtctccagaaaataggcgagtggggcggggggatggggggggaattcccagcctcaggctctaaaattcccagttagtctgtggtgcagacaggactccctgcctccttgttcagggaagtaggggaggatcaaggccacactgggcaccaggagctggaagaacaagagggtctctggcccagagtctgggatggggagaggcagagggggcattggaaattggggacacatctttgaactgagataacagctgttgccaagaccagcacctgggccaggctaaggaagggcagggctaaaggtgggggagctaagggtcaggcagggccttgaacgccgtgttcaggaggctggcctttatccctcaggacctggggagccatggaaagatctgaggagcaggcattgggcacagctggacactggggaacgggtgacacaggggcatggatccagcccaactctgataaggaacagcagagttccacaggaccatagtggcagaggcagcagtgaggacttcttttttatttatttgtttgtttgagacagagtctagctctgtcccccaggctgcagtgcagtggcgtgatctcagctcactgcaacctccgcctcccgggttcaagcgattctcctgcctcagcctcccgagtagctgggactacaggcgcatgccaccacgcccggctaaattttgtacttttttagtagagacagggttttaccttgttagccaggatggtctcaatctcctgacctcgtggtccgcccacctccgcctcccaaagtgctgggattacaggcgtgagccaccgcgcccggccggcaatgggggcttcttaaaaaagagggaggctgggcccggtggttcacgcctgtaatcccagcactttgggaggccgaggcgggcggatcacgaggtcaggagttcgagaccagcctgaccaacatggtgaaacaccgtctctactaaaaaatacaaaagttagccgggcgtggtggcgggcgcctgtaatcccagctactcgggaggctgaggcaggagaatcgcttgaacccgggaggtggaggttgcagtgagccgagatcgcg

SEQ ID NO: 383 - DNA, 2738 bp, Homo sapiens
  cDNA ADORA2A-201
gagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggaaaaaaacagaccacatctgatccttggccctgagtccagagtgggaggcaccgtgacaacaatgcgcagagcagggaatgcagggagccatggatagtgctggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgag

SEQ ID NO: 384 - DNA, 2632 bp, Homo sapiens
  cDNA ADORA2A-203
gagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgag

SEQ ID NO: 385 - DNA, 2567 bp, Homo sapiens
  cDNA ADORA2A-001
acagcctgtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgaagcctcgtgtgagggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgag

SEQ ID NO: 386 - DNA, 2414 bp, Homo sapiens
  cDNA ADORA2A-202
gactcccaggcccgaggactcctggaagggaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgag

SEQ ID NO: 387 - DNA, 13166 bp, Homo sapiens
  Coding Sequence of the BTNL2 Gene
ctcttttcagctcctcttcctgggcaggcctacagccacagcaagaagcaatccccaaacaagcagtgttttccacaaaaacgtcatcctggactctaaaatggaaacccaagaatcccttgaaactgtgaaactgggacaatattaagattgtacttttcatctgagcagcttctaggctggagagaagggagagaatttggcctcccaggaagcagttggcctgctcctccctgctctggagatgcagaggagagaatgcaagtatttcatgtttgctcgtctcagaaatgtacacatgcacagacaagttttcccttctctcttccaactatatcacacaatcactggaatgacttgaggaggaaaggataaaattactcaagccgcaaccatgaagatggtattaataaaaatcagtttctaatccagaagaaaatcctccatgagggggaaaacacaaagttctgtaatttaattgttttcacatcagaagaagagaatttaaagagagagagtgaaaacagggtcaattacgagaatttagtgtgtatccaatgataaaaataattgcagggcgctagttgagggtgtcagagagaaactcagaggagtagaatccctgggtgtcctgaaaaccagctttgcagaggatagcaggagacctcgtcagagatcagcaaataaaaatcacaaaggaagaagagcaatacaatgagtaagtctgagttggtcttcatatttattttccaaacctgaaggaacataaggaatcaccaacctgagagagaaaaagttgcgattttctcctcgcccaaaaaggggatgctgatggaacaagtgacgtccacagcggagatgtttgtgacccttagcaatgtctgcacgtggaacagcccgtggctgccttgagtcagggcctgggaagatgatggtatcgtctttccttccatgtccctccatggcacgtggggctgtgggaaccacccatctgaagagcacatcggctgcatttctccatcttcttgcccctccacagtgatcagtggggaagaacccagacctggggcagagaaagcaaccaaagcctggggtcctttcaagtggatgagtgggcagcaatttcactgggaggaaagaaggggatgtggagggcttggggaagggagaaaagcttaagggggattgcactccacttagggatgaggctggctggagcattttcttattttgtttgtttgcttatttttattctttgtattcctaaatcattctgggatgattaagaggtaaggtaaatgttcaaatccaacatttattctgtccctgagaacaaaataacttcggccagggcatgggtcacatggacaggattaacatacggagtaggaggatattctcaaaaatcgaaaccttataaatatctacgtccaatggcagaaaatacgaggctcatgaaacttctcaacatgcgctcccatggctaaacgtgtttattaatttagaatcaaaatccgtgggagaaacacgtagcatatccaagacttgggcctatatgtactcaatggcatctgctaaccttggacgtttcaattctcacacacacggacagtgggaaatgatgctgcagggagtgatttcatcttttctcccctgtccctgccaaaactgtcaatatttataattttggtttacacagtggatccagtttagtcttcagatgattacagtttctagaattttattgcatttctcagaattctaataacacactgtgaaacaatgagccttttgtaaaatatgtagtaagatactcagatttccttaaagatatggtcaatttttgaagatactggaaaagatacaagttatatgcccaaataattaaatttcatccatttgagtttgtggattttaagtaactatgacagtttcacacactggaggatttgatataaatttgatgatgaataagcattaagaaaatttcaaatgtcagagaaattgtccaggaactagcatattaaagtggcaggagcaggtattgaatacaaaatatctatctagaattcttacttaccaccttcagatccaaactggcctcctggtagacatcatctttttcaaaaaggcagcggtactgcccgtcgtccgaaggtctggcactgagtatctgcagggtcagtctgccctcgtcaatggcgtcactcaccagtacagtcctccctctgtactctgccatctgctctccagccacatggtccccatccatatacacatgcacagcagggtaacggtgggatcggtcccacctcacctccatgctctgtgcattcgccttgggggacaggtaacaggttagctgtatatcttctcccactctgacgaggatgggctgggaaggtccattcacttttaaagaagctgttaaatagagtggacaaaacacaatgaaagaatcaaaatggaaccaataatgtcatctctaagaacagctccattggagtttagaaaccatgagcatcccagggttgctgtgaggctcagggtcatccttaggtgaggtgggggtttcatggactcagaatagaggttgctcttctttaaggaggaatcattccatgatgtgtgtcagtctgagtaaaacagtaattgaatccctacctgcttctacctgtatttttttcagtttacagaccaataataaaataattttgcaattaaaactcccagataggctgggtgtggtggctcaagtctataatcccagcactttgggaggccgaagcgggtggatcaccagaggtcaggagttcaagaccagcctggccaacatggtgaaaccccgtctctacagaaatacaaaaattagtcgggcatgatggtgggtgcctgtaatcccagctactcaggaggctgaggtggaaaaattgctcgaacccgggaggcagaggttgcagtgagctgagatcatgccactgcactccaggctgggtgacaaagcgagactttaaaaacaaacaaacaaaaaacacccagaataaagtgaacagtttataaatttggccccagatgcctctgtacctgactccttatgtaacaaactgcaatttaacttagtacgtcaactactgaaagcctaacttaggttgcagtttgttacataagcactcaggtacagaggcatcctggggccaaatttataaattgctcattttattctgagagttttaattgcaaaattattttatgaataagcctaacttaggagctaaggctaacttaggagtacacttttgtaataaatagctgagtagcagctgctgcacttctgttagttgcaggcagccaactgttgaaaccctgttcaaatcggcaaacgccaggctgcaaccaatagagctgtctctgtacctcacttctgttttctgtacctcatttccattttctgtccataaatgctgtctgaccaaattgctgctttgaattctctgaaaccgttctgattctgagggatggcttgtttatgagtcatccttttctcagttagactctgctaaatttagtctgtctaaagtttttcttctaacacttcaattctgtatgattttaaactacttcttaatctgtcttaaactacttcttaatgcctcagtttcttaaactgtaaatttgctatacaactaccaaaatcataatgtttcagagttgaacaaaatagtttgcattaagtgcctggaagaccctgcagcgtgagcagaggtgcacagacctgtgagacttgaaggcgttggagccatccccaccctctgacgtggtaatagggaggggtttaaaaacatgtctcatgtggacttttggtaatgatatttgaagaagctttcctctaggtggactttatagtaccttgtaagtctggtccagccgctatattttatttccccaatgctccacataggtggagttatagacacacaccagttgaatgtcctcaaataattttgaaaattaaaattaacattttaagatcaataattggggaagtcggcaaagtacaaattgtgaaacaatgatgaatgtaaaaaaggggtctaattctctcactgtgcaaagtggggaaagatgttctctgagggctttcctgggcccaagctatattacattttccattctcatcaggccctgcccgtgccattttttctctattctaaattaagtgtcgtccttttctgttaaatgataagaatggttttgcataaggtgtgatcatttataatagaaacacaagcataaaattgttggttctctgcatagagtcactggccaaaggcgttaacatcccattatgtcattggccgaaaactgccagctacctttgtagagaggaaagtccctgtcaacacaatttgaattttcagattattaccttccattccaggtaacagttgactcccagttatttccagcattttgtttgctttgtcctgtaattttacctaaaacaatattattttcctctcctatgtatctattaaagtctgaagacaagaatcagaaaaaatggactagggattagtttggggctgtttctgcatccacatggcttacggtaaattacttaataaaacagactgtttcctcatctcctttatccatatgaggattttattccctgtccgtgtgtgacctgtgcacatattagatcttaaactggcttgccctgcctgacataggtaattaagagctaaaattgacttcaatggagactgaaggaagcaaaatgtaagtatggagattcaattaatttgatgcattacagatacagacaaaactccttttgtccagaatccaagtaaaactaaagtttaaagtgctaaaaaaatcatgcagccctgtttgttaataattgatgttctactagaatacaagctccttgggagccactatgcctaacccactttttttttctttcaattttaagttccggggtacatgtgcaggatgtgcaggtttgttacataggtaaacatgtgccatggtggcttactgcacaggtcatcccatcacccaggtgttaagcccagcatccattagctgttcttcctgatgctctccctcccccatcccccaacaggtgtccagtgtgtgttgttccctgccatgcatccatgtgttctcaccaatcagctcccccttataagtgtgaacatgcagtagttaacctcctttttctatacggttttgtacacagccttccagacaattttgtgctgaaatgtattgctttgttttgttttggttattgtttgtatgttctgaatgccttctgaatatccactgaaaaattaattcccttctggagcgtgaagtacactgaattatacactgattccttgaaacctgataatctcatcatcataccacataatcctctttcaatcagcatattcaattaatgcactatctcatttctcaaatatgctaagttatatctaatctcttagaactggacactacattagagattaaattcaacctgttcactttaaagatgagaaaaatagagatgaatgagctgacaaagtcacacataagtaattaaggacttgcactgttaagttagatagatgtagattagaaggtaaacatcaccatttcttcctgatttttggcaaaccatgtatgtctctaagattgtttcttagctgtaatatgaggataaagcaattaaactttataattattgtaagaaaaaatgaaataattcccataacatattcagcatcgtgcctggcatacaattaatatttttaaaaactattatttttataaatgaaaaacattatttgtaagactacaagcagtgatttcagtcttaggacttccatagagagctgggtgtcccatcattagagctcacctgcaaagcttccgtgcccagagccctcctctcccacctgacaggaagcaaagggaagctccatctttccgtgttggttaattgtggccccggaggttaccatgacttaggaacaacaggacatggggtcgtattgtgtgtgctgggtctccagtgggtctcagagaactcagaggagtgactcttctcctaaaaccttcttgagagacagacttgtgtcaacctgccccaaacactggctttacttcctgatctcagaagggtaagatacacaggtgtgtgtctctcctcagattgtggagttactttgcgccttccagggacccttccctttatgtttatggcctaatggggttgaaggtgccatagtagactctggtagagattgggttgtgtttgttaccctgattttcctcaaaaactcttttgtgggctgaaaggtgtgcttaagctcacctaaagcacacacatggatacacattcctggagcaggtgacttgatggagagcaaggaattgatggaaagagcacataagggatccacgttctatgcacctaggcagggaggcaggctggttgccttgggctgggagaagaggccataaaaaggagggagctagtaaggaggtaaaggggaaactcaaaggggctcagccatcggctggttatgttttaaaccacttatctcaggtgcagcaaaataataccctcagtccaactccgagatttaaaaaacaaaaattaggctgggtgcagtggctcatgcctgtaatcccagcacctttgggaggccaaggccggcggatcatgaggtcaggagatcgagaccatcctggccaacatggtgaaaccccgtctctactaaaaaaaaaaaaaaaaaattagctgggtgtggtggcgcatgcctgtagtcccagttactcaggaggctgaagcaggagaatagcttgaatccaggagatggaggttgcagtgagccaagatggcgccattgcactccagcttgggcaacagagcgagactccgtctcaaaaaaaaaaaaaatgcccggcgtggtggctcacgcctgtaatcccagcactttgggaggctgaggtggggggatcacgagatcaggagatcgagaccatcctggctaacacggtgaaatctcgtctctactaaaaatacaaaaaattagccgggcgtggtggcggttgcctgtagtcccagctacttgggaggctgaggcaggagaatggcctgaacctgggaggcggagcttgcagtgagccaagatcgcgccactgcactccagcctgggcgacagagcaagactccgtctcaaaaaaaaaaaaaaaaaaaaaaaaaaaaaaaaaaaaattgctacactcacagtatcccaggttgcactcagaaagtaacagctccctcccaatagtgattagcttaggggtgtactggggtgaggagcaggtgcaggaccccatagcagagttgagcagggaggtgctgggtgcaacccaggttgtcataatgatgctgcccttgttcacacttgaaatgttttcaaagggcctccaggccccggccagctgtctgctgtcatcccccacacattctgaggcagctccctttcccctcaacacatagaacagagatgatgccatgcttcctataggtgtccatctgatgctcactggaatctccatgagcccccaaagtgtcaggtaacacagctgcaacctccttgaatgaggccattactttgctggtctcctctggtatttaatgaacataggacctggtaaaatcgtgcctcagtttttcctctgggtcacatggtctcgtggtagctcccctccctctgctggggagggcagaggctccctccacaggtgtgtgccagcacctcgtacttacccagctcagtctggagtttctctggaaaaagaacaagaataacatattaaggaatttggtgtaagggaaaggagagaaactattttttaaaaaagaaagcaatttatacattatatagggaagctcaattcattaaaaaaatgaaatgcagaaaaatactgattctttcccacagattacccaatgatacagctttttttccttttctctgcacaacaaaaatgctgtcacttctatctccccatgattctgttggtttcttctgatatttacagcataaatacttagctatcagcatgaaaataacatatgttccttttatagatacacagaaagtacaaaattatatggacataaacagtatcacctaaattacaaagtagagagacgaattatatgtaatatacaatcagcttcatttaaaattaaaatgtaacattaactttaaagtttttttaatctatccatttatatgaataactgtatacttatatccaaatgtggagggtatcctgaaagttttagtgcagttataagttatttaaggccagtaacttttatgtgattggaaatgtcaatttataggtagatgtcatgtttatcattgaatagtgcatcatgaggatttttttcaaccattaaaattatttaaaaatatctttttattaatgctataatgtatagtaagacaagattccacactgtactgttgtattggggggttggttgtttttgctgctatttataaataaggccataattaatattctattatgcaaatagttgtctacatctctgattatcttcatatgatagatttctagaagtaatcagcacaagacagcataggaaaacatttcagttgaagaaatatagctttattttctttacaatgcaatgaatacttgtgagtaaaaacaatcaatgcagaagaaggaaaggtagaactcaaaaataacgcaggcgccataacagctattcaagtaaaatgtagtgcgtatatttccagtcataaatgttttatggctttcaatacatattgctatatgatagataatgtctcttgataaaaatacgaggtgctatggtgcagtccctgggacctctcctgctgatctgagcatgtgggtcctagaggcagagcactgacctgggaggctgatgaccgaccccttctcctcagtgaggacggggttgtggaccaagcaggacacagactctgcagaggcgttcctgaccaccagggtggcttccgcatagaacaggccatctttatcttggatgcgatgctcagacacggccagcagcttctctccccggatgtcttcccaatacacctggggctctgggaaccagccccttgcagtgcacacaagctggactccactctccccaggtccctccatgtggatgctaggggcagaccccagacctgcagagggaagccacagctctgacacccagagcccacagaggcagaaatcacagaggctgagatcccagtgacgttgctcacagggaggtggccggagttcaggagtctgaggagcagaaagtcgacctcagtctccccattcaaatgtgagttcagatacactttatttgttccccagtctgggtctttacattttagcatctgaccagtacttttctccagatccagaaaggggaatcggagaagggggacatcatgacattttgcaacgcctctagcactgcaaacagagatgagctgtaatttattcattaattcctctgtgccatgaactctgcctttttcatcttaaaattatctgtattgggcacattgtctggtattttagatgatgtcttgaactccaatttgattgaagatttaacacaaagtcagaaatcactccccaggggcctgttcttcctgcatcttttgctggtggctgtgatcttcggaagcaagtggataaacgggagcatgtgaaatgcgaatctccacgaggcgttatttgtagctaaatattctattcaatgggtaagatggttttgagaaatcctagtttacaacagtttatgaaatcatgaattttttttctctatttaacgtgaaactcccacacccaaactaaggggactatattttccataaatgggaattctgtcttaatcacttgctggtaaaagagagatccactcccttcccttggacccttagaaaatgtgtgacttatttgtaaatgttcctgatattgaaatacatcagtacgttccctgtccccccatgtcagaaatatatgtattcctccatccattttgaatcaccttgaacacagtaacagtaatggatgttaagaaaaaaaaaggtattaggaaacagcctcccagggaagtaaagaaggaagcagtatcagctggagacgttaacatctccagagaactattttccccatttgccttagtaattggatttacttgattttctctttagagcatggagaagttagccctgtcagggaatcatatgatagtttacttttcataagacagatccattcttcagttgtccccttcttccctactccttcctgcttagctaatacaacagcaatatgaagaaccttcccattcacagagggtgtgtccaaaagcatctgtgagtccccaattcattgaacactagtatataacaatctccaaagcacgacattcttagccttttcagtcttgttgatagctttctaactgagggcatttcacaaggaaagaacattttcacgtctcagtttctgcatagatgggattgggtagagaaaaaccaatgccctgagatacagatgccggacgtcagctgggctcattcatgcagcaattggtttgctcttgcgcaccagccttaggtagcacaaatgtgtgtctcagcaaaattgctaaagactgcatgtcatggattccaaataatcctcaagaacagtcaaaactgtgcaaattaaatttgggaaaatattttaacactaagcttgaagactccagaaccacttatttttaaatcaatcagggtagaggactaagcattaggaattaccttgatgattcaaaaggatttcctcaactgtcacaaagcttaccacaaattaatatatctctgcctcttgagaccctgtgtctttccccagatattcacctgctactttgagcagcaagcttgtttctccacagtagttcccatcctggaaatggcaccagtattgtccattgtcggagggctggatgttgtgtatcttcagtgccacatttccctttgcaatgccattctctatccactctacccagcctctgtactcctccatctgcatctcagtcacctccactccatccctgtgcacaaacacaggtgtgctgggctctgagcggtaccacctcacctccacgtgcattgtggtcctcttggggagtagctggcaggttaacagggcatcttccccaaccccggccaggataggatgagcagggccaatgactctaaagtcttctataaaataagtgaaaaagaggaacgaggaaatgccaatcagaaaatcatatgcatgctttggggtgtccagcctgtcaaaatggaggcaactagaagagggagagatatatgtttaatgttttagagaaatccagcatgatgatttgcacatctgtttgttacagagtcaattttgtgtactgaaaacaaatgcagttcaaaaatgtgggtgaggttgctgtctgtcacctaccagctatgtgattcggtggcaaatctattactcttggtaagattttgagatttgaagtcctaatttcttcatcttcaagatattaataccagcatacctgggttgtttttattctcaagtaaattatttattccttgagtcatttattctcatgtaaattgactttttaaattggaaaccttattcttgttattaacattttattttcctgaagtttagataataaatccatttattagctttttttagcctttcaggattcctcttctcttagatataaaaactgttttttttttgttttttttttgtttgtttttttcccgtctggagttggcaggaggccaattactgggactatgtacaatgcagttttcacaaggacattttgtgctggattaaggacactggtttgtctagagatttttgggtcttccaaacaaattctaagacatgtctgatctcttccttgttatctgcaaattgaagagatgtttaacagttatgtatgttattatgtttgatcattttatgtcatgtatgatatgttctttctcattctaaatgctccggggccatttgctctttctctgtgcagatccaatcctgctaggaagaacctcaccctacttagctgctgctgggtatcaaatagatgctgctcaaaaggtggctaaagagcctaagtggagatctgcttgtattcttcattgatgaagtctaaatatgaagctagaactgaagacattccatcagattgactgttacagggtagggagctgcagcacaagcacagagaagccagcagcttcatcacatcacaccagctctgcagcgccaaggcagacacaccagctctgcggcaccgaggcagacacaccagctctgcggtgccgaggcagagcctgcgccctctgatgctctgtgtcgtgttttttcccacttcgccatgctgcattttccttagggctctgacatctccttctgacactgattttttttttttgacactgaatttttaaataattatttttcaaggtgcaacattttgacgtcaaaattcagctagtgagatttccaaagtccctttcttctaatttcttatttccaagtattttttttaattgcagcttaatttatgataagaagcagctgcatttcttgaccccaaagtactagagtgaattaataatttaacgtggtgcaaccactgattcaagtgcttttaatgtctcatttaatcctaaagcctgtgctggcctctgagatgtagttactgctgttattctcattaaaaagatgaaagaactaaggtatgaggtgctcaagtaactttccaaaggtgactcagctaggagtggaggagctcctgggagtggaggagctcctcaaaagtgaggagttcctttttggatacaggtggcttggccccagacttacactcttagatgttgttctcgacctttggacccagactagctcactgggacattagactatacagtaaagggagaagggaatcctacctgactgcttcattgtcagcaggatgaataggaaggaggcgactgcaccagacagattgtagcctggaaaatccaccatcctcc

SEQ ID NO: 388 - DNA, 26332 bp, Homo sapiens
  Sequence of the BTNL2 Gene
cctagaaggtttccaggacagcaaggctggagacgtgtcttttcacaacgaggtcgattagtcccacatctattctcttactggaatcaccttctgtgggattttccatccttattctagccttcagagtgctggcacatctgtgaccttctgcttagatcatcatgaaaattgtcctgattcttttccagttacccctgtaacttctttaacgagttgtgatagagatgttgcccaggaagctaatgttctattagcataataagcagcgaagtgttggcacctctgctgtctccactggagcatcttctaggtacattcaccaggaaagctgtccttggatggtgagtaggtcagtttcactaggtgtgatttcactttctgtcaaagaggaagaggcagaaagtgaagtgagagaactggaaaatgtccagggagatttcctccggtgctgctattggggaaatacagtctctttgtgggcagcaactatttctcacaagaaaactccaaacaagttcatggatttctcatctgttttcatgctgagtgtgtgttgaagtatataattttaaagctacatttacagggaaatctcttcttactatttttgttatcaaatatggaggaggggaggcgtttgaagggaagtattgcagtagagtgaattctcacttccattaccactgttggagatgcataggaatctgtccaagtcctttaatagctcagcgtgtttgctcttcaggctctagtgtacaatcaactgctaatcttggactttgacaagggacggagaaggctcatgaataattgtaaataattggaggaggagcccaagccttctggaaggaaagagcccttttctttaataagttctcactggtcagcaagtccagaattgtgtcctatgtgagaatgtgaatgaaagaggagtcaatgttgcagtttatactttaggagagaaagcagtaaagtagaaataaagaaacatctgtaccaagagtcattgctaacattaacattctttttcttcctgacctgttctgcccactgttgagggtttcccttgtccttgctgcatgtaagacttctccagctgtttatcatcaagttgtcttcaaggatatagaatatgagcttctcctgctttttgtttgtttgtgtatttttgtttgtttgtttgttttttctttgacggagtctcgctctgtcaccaggctggagtgctgtggcaccatctctgctcactgtaacctgcacctcccaggttcaagcgattctcctgcctcagcctcctgagtagctgggactataggcatgtaccaccacgcccagctaatttttgtattttttttaatactttaagttctagggtacatgtgcacaacgtgcaggtttgttacacatgtatacatgtgccatgttggtttgctgcacccatcaactcatcatttaaattaggtatttctcctaatgctatccctccccgctcctcccaccccacgacagaccctggtgtgtgatgttccccgccctgtgtccaggtgttctcattgttcaattcccacgcagccataaaaaaggatgagttcatatcctttgtagggacatggatgaacctggaaaccacaatttttgtatttttagtataagagagagggtttcaccgtgttggcccagatggtctccatctctttaccttgtgatccacccgccttgtcctcagaaagtgttgggattacaggcgtgagccaccgcacctggccgagcttcttctgttaaatgaaccctttcttcctgatgatggaagagatccccttagtttttcttctacagtatttgcagatctgtaaaccacaagtgcctctaacaatctgtcctgtagatgtatctccttggtgaaatttcacgtcacacactaagtggcaaagacagtattcgaagccaggaagaatcaagccagagcctagtcctaatttcactgaccctaaagggaggcttacatatttcatcaagaaataatcaaggcaggacagaggtaaataaatggtgataaaatattaatagttataatcaaatggacatggtggatgagaagggatttctggacatgcgagccctaaacatgggggtaacaacaaaacaggaacaaatggggtggaactgtggtatagaacacgaaatgtaacaggttcagccttagacattttacttttttatacacttaggacattcagcatgaggttcaagaggagtttttactatctctttttcagagtctaaattcatattttttctacaacaagattcttaaacttgtcacttctttactcattttaatgggtgtttgtccttctaagcttagagattggggagcagtggctgcaggtggacatggtagaaaacgtgaaggtggatggttgattggactcagagctttagacctgtcagggataacagtgtccatcttattttcatttgtagctttgagtaaatcaataagtagtgcagggtctccaagtagcctatcctttctggaaaagtgaattcaccacctggctacatcaattaattctttattgctggactactctggcactcccatttttagtaaagtttatgaaggtataataagacattccaaaaacagagtgactccactgcaaaaaagaaagacctgagggcaggaattatgtcttattaaggattgtatctctaggccttagcatagtacattcaacaggtaagatattcaataaatatcactttatgagacaattcatgcattttacaaatgtttattgataatcaatgtatgtcatttttacaggttgtggggctagacaagaaggaaaaaaatcactgtcctcatggaagttaaattgtactgacaaaggaggaaaatgtcagggagttaacaattcagtctctgtggcttcctcctgtcctctccctgaaactgagatccagccaatctgcacatttattctgagagtggccccactttaatgactacacccagctgtctacacaccaggaggggagggaactgtatcctgaggcaccaacccgattacccacccaacagccacagggacttccagtgactggggcatcatcctcaatgccaccaacccctctccttcctgtggcttttctaactggaactggaactcagaaagtacattaatcaccaatttgggaagctataggaaagtatgttttctaatatacagtgagagaatgtgactgataaaaccaattttcttgagactttctccctggaaagtgaatatatgtattcatagggccttcacaagcacagactaacaagcaaagagctacattcactgggaaggaagactcaaaagtaagtgaaaaataatagttaacctttagatgttgtgcaataaattatttttaattacattaaatcaaaatagtgttaaaatattttcaggtaaacctagtatatttactaataaatttaagtcttcataaatataaagatagatcaatgtaaatgtaaaaatcatttgttaaactccagagattatataaacaaaaggtgaacctaatgtaaaactgtggactttagttgaaaataatgtgtcactattctttcatgggttgtaacaaatgtgccacactaatgtaagatgttaataatagcagaaataggggggagagaggagggatctaggagctctctggattttccattttattttgttataaatctaaaactgttcttaaaaataatgtctgttaattttttttttaaaaaggaaagaagcactgatacatgctatgacatggaagaactctaaaaatattaggctaagggaaagaagccacatacacatacacatacacagatagtttatggttccatttatataaaatattcagaatagaaaagttcatagggacagaaagtagattacctggggagtagggggtgaaaaatgggtagtaactgcttaatgggtatgaagtttcgtttagggcgatgaaaatattctggaactagaaagtgatgatgatggtcacacagcaatgtcacatatacaataccacagaactgtacactttaaaatggttaaagggttttattttatgttatgtattttaccacaattgaaaaaaatgtttattaaaattaatgtgtaaacatttgtggaagaataatgtgtagtttctaacatttatgtgtttaaatttatgagtttaaaaatagaaaaaaaaatgatggcccagaagagcaagttcagagtgctgttcatgagtgatccgcatgggaccgcgatgcctctgacgtctgccatcctggagagcagcagagcgtcactagcaggtcctcgtcttctcacttcataacattctttccaaaagtcttgttgacattcttctgtcttccacatatagtttatcttcttgaactcattataactttaaaatatttttactgtgttacatgtactgcttatatttgtttattttataattattaattttaaattgtgcactttattttgctctaacaataaaattgacatgttcgtatagatgatacataatttttcgcttggatcggaaagtgtaaaatttttttcctgactcaatttcctgtatcaactttctcaaaaagtctggaggagggattttacaacacttcataagattttcaagattatattttagtgatcagatttttctcccccttatgcagctgtattttctttcacttttttttaactgtatatatatattttttattttctcagttccacctatgtggacaattaattgtcaccatcttaaataaactgatcaggccaggtgtggtggctcatgcctgtaattccagcactttgggaggccgaggcgagtggatcatttgaggccagaagtttgagaccagcctggccaacaaagtgaaaccccatctctactaaaaatacaaaaataggctgggcatggtggcacatgcctgtaatcccagctactcatgagactgaggcaagagaattgcttgaacccgggaggcagaggttgcagtcagctgagatcatgccactgcactccagcctgggtgacagagtgagactttgtctcagaaaaaaaaaaaaaaaaaaaaaaagaaaagaaaaaaaaaaaaaaaaagaaactgaccaaatccttgattattcctttcatttcttcctgtaggctaaattgtatttcccatgggattttctaagggtccttgattatcagatgtcagattgtgattgataggccggatctcagagaacctggaacaggataggtctctgaaaagatcagtctccagcagattttcctgagtagaattaaaacaccttgagttagtacttcaatgatcatggcagcccccttcaagcagttagagaaatgagaaatgatcaggactcagaatatcattctggtttccagaatcccagattgttattttcctgatacgttggagatgttcttgtgggtacagaaaaaatgtccagagaacctacattagggaaccaaagaatgaagcggggtgcagagtcccagagaaggaagttttggggaaggtgtagatagggcacttgccaatcatgttataagaggagaggtattcagaggcacggtcagggggattctgacttgttcaggggccaccttcaaggggatggggcttggaagagaggggatggcccagaactcatttcttttgcaatccattgcctaaaactcactgtcaggtgacacagagatgactctttctttgcaacatgtgcttggcaacctccgggacccatcgcgccctgttcccagtctccacctctcagtaccagctccctgacaggagttccctctggcccatagagcagatagtcagatctctgtgggatatctggctgcctgaatgtccatggatcacacgcttgttctgttcagaagaaatcagtctcaggtgagctgtgtttgaagccaatgtcacattcactgtaaagaaagagaatccattctgataattaatcaatataatttcattctattaacagccaaacaggaagacaagtgtttcacggacataagaaatttaaagtggaagcactttctagagcacacaaaacagcctccctaacacatgagaagtcaccagcaacacagaaatcaccaacaagtaggtcaccacatttttaaagatcataggaaattgttcacgccaacaaatctcagtgaacctcagctctcagccttgaaaacaaggatggctgtactactcacttttttcttcttcttccctaaccagatcactggggaatgggcagcaggaaatcaaatcattatcttttaatcattttgcttctattacaagtggaaacactgacctcatgcatcactgagcctggattgcatgataagccctgggctttcctgtttctcatgtttccttagttactggatattcactgactgcctcccataggtgacttgtgaaaagggaggctcggggaagtacgcagtacggttcccactgcagtgtgctccgctgtttctgtttccctgacttacctcttttcagctcctcttcctgggcaggcctacagccacagcaagaagcaatccccaaacaagcagtgttttccacaaaaacgtcatcctggactctaaaatggaaacccaagaatcccttgaaactgtgaaactgggacaatattaagattgtacttttcatctgagcagcttctaggctggagagaagggagagaatttggcctcccaggaagcagttggcctgctcctccctgctctggagatgcagaggagagaatgcaagtatttcatgtttgctcgtctcagaaatgtacacatgcacagacaagttttcccttctctcttccaactatatcacacaatcactggaatgacttgaggaggaaaggataaaattactcaagccgcaaccatgaagatggtattaataaaaatcagtttctaatccagaagaaaatcctccatgagggggaaaacacaaagttctgtaatttaattgttttcacatcagaagaagagaatttaaagagagagagtgaaaacagggtcaattacgagaatttagtgtgtatccaatgataaaaataattgcagggcgctagttgagggtgtcagagagaaactcagaggagtagaatccctgggtgtcctgaaaaccagctttgcagaggatagcaggagacctcgtcagagatcagcaaataaaaatcacaaaggaagaagagcaatacaatgagtaagtctgagttggtcttcatatttattttccaaacctgaaggaacataaggaatcaccaacctgagagagaaaaagttgcgattttctcctcgcccaaaaaggggatgctgatggaacaagtgacgtccacagcggagatgtttgtgacccttagcaatgtctgcacgtggaacagcccgtggctgccttgagtcagggcctgggaagatgatggtatcgtctttccttccatgtccctccatggcacgtggggctgtgggaaccacccatctgaagagcacatcggctgcatttctccatcttcttgcccctccacagtgatcagtggggaagaacccagacctggggcagagaaagcaaccaaagcctggggtcctttcaagtggatgagtgggcagcaatttcactgggaggaaagaaggggatgtggagggcttggggaagggagaaaagcttaagggggattgcactccacttagggatgaggctggctggagcattttcttattttgtttgtttgcttatttttattctttgtattcctaaatcattctgggatgattaagaggtaaggtaaatgttcaaatccaacatttattctgtccctgagaacaaaataacttcggccagggcatgggtcacatggacaggattaacatacggagtaggaggatattctcaaaaatcgaaaccttataaatatctacgtccaatggcagaaaatacgaggctcatgaaacttctcaacatgcgctcccatggctaaacgtgtttattaatttagaatcaaaatccgtgggagaaacacgtagcatatccaagacttgggcctatatgtactcaatggcatctgctaaccttggacgtttcaattctcacacacacggacagtgggaaatgatgctgcagggagtgatttcatcttttctcccctgtccctgccaaaactgtcaatatttataattttggtttacacagtggatccagtttagtcttcagatgattacagtttctagaattttattgcatttctcagaattctaataacacactgtgaaacaatgagccttttgtaaaatatgtagtaagatactcagatttccttaaagatatggtcaatttttgaagatactggaaaagatacaagttatatgcccaaataattaaatttcatccatttgagtttgtggattttaagtaactatgacagtttcacacactggaggatttgatataaatttgatgatgaataagcattaagaaaatttcaaatgtcagagaaattgtccaggaactagcatattaaagtggcaggagcaggtattgaatacaaaatatctatctagaattcttacttaccaccttcagatccaaactggcctcctggtagacatcatctttttcaaaaaggcagcggtactgcccgtcgtccgaaggtctggcactgagtatctgcagggtcagtctgccctcgtcaatggcgtcactcaccagtacagtcctccctctgtactctgccatctgctctccagccacatggtccccatccatatacacatgcacagcagggtaacggtgggatcggtcccacctcacctccatgctctgtgcattcgccttgggggacaggtaacaggttagctgtatatcttctcccactctgacgaggatgggctgggaaggtccattcacttttaaagaagctgttaaatagagtggacaaaacacaatgaaagaatcaaaatggaaccaataatgtcatctctaagaacagctccattggagtttagaaaccatgagcatcccagggttgctgtgaggctcagggtcatccttaggtgaggtgggggtttcatggactcagaatagaggttgctcttctttaaggaggaatcattccatgatgtgtgtcagtctgagtaaaacagtaattgaatccctacctgcttctacctgtatttttttcagtttacagaccaataataaaataattttgcaattaaaactcccagataggctgggtgtggtggctcaagtctataatcccagcactttgggaggccgaagcgggtggatcaccagaggtcaggagttcaagaccagcctggccaacatggtgaaaccccgtctctacagaaatacaaaaattagtcgggcatgatggtgggtgcctgtaatcccagctactcaggaggctgaggtggaaaaattgctcgaacccgggaggcagaggttgcagtgagctgagatcatgccactgcactccaggctgggtgacaaagcgagactttaaaaacaaacaaacaaaaaacacccagaataaagtgaacagtttataaatttggccccagatgcctctgtacctgactccttatgtaacaaactgcaatttaacttagtacgtcaactactgaaagcctaacttaggttgcagtttgttacataagcactcaggtacagaggcatcctggggccaaatttataaattgctcattttattctgagagttttaattgcaaaattattttatgaataagcctaacttaggagctaaggctaacttaggagtacacttttgtaataaatagctgagtagcagctgctgcacttctgttagttgcaggcagccaactgttgaaaccctgttcaaatcggcaaacgccaggctgcaaccaatagagctgtctctgtacctcacttctgttttctgtacctcatttccattttctgtccataaatgctgtctgaccaaattgctgctttgaattctctgaaaccgttctgattctgagggatggcttgtttatgagtcatccttttctcagttagactctgctaaatttagtctgtctaaagtttttcttctaacacttcaattctgtatgattttaaactacttcttaatctgtcttaaactacttcttaatgcctcagtttcttaaactgtaaatttgctatacaactaccaaaatcataatgtttcagagttgaacaaaatagtttgcattaagtgcctggaagaccctgcagcgtgagcagaggtgcacagacctgtgagacttgaaggcgttggagccatccccaccctctgacgtggtaatagggaggggtttaaaaacatgtctcatgtggacttttggtaatgatatttgaagaagctttcctctaggtggactttatagtaccttgtaagtctggtccagccgctatattttatttccccaatgctccacataggtggagttatagacacacaccagttgaatgtcctcaaataattttgaaaattaaaattaacattttaagatcaataattggggaagtcggcaaagtacaaattgtgaaacaatgatgaatgtaaaaaaggggtctaattctctcactgtgcaaagtggggaaagatgttctctgagggctttcctgggcccaagctatattacattttccattctcatcaggccctgcccgtgccattttttctctattctaaattaagtgtcgtccttttctgttaaatgataagaatggttttgcataaggtgtgatcatttataatagaaacacaagcataaaattgttggttctctgcatagagtcactggccaaaggcgttaacatcccattatgtcattggccgaaaactgccagctacctttgtagagaggaaagtccctgtcaacacaatttgaattttcagattattaccttccattccaggtaacagttgactcccagttatttccagcattttgtttgctttgtcctgtaattttacctaaaacaatattattttcctctcctatgtatctattaaagtctgaagacaagaatcagaaaaaatggactagggattagtttggggctgtttctgcatccacatggcttacggtaaattacttaataaaacagactgtttcctcatctcctttatccatatgaggattttattccctgtccgtgtgtgacctgtgcacatattagatcttaaactggcttgccctgcctgacataggtaattaagagctaaaattgacttcaatggagactgaaggaagcaaaatgtaagtatggagattcaattaatttgatgcattacagatacagacaaaactccttttgtccagaatccaagtaaaactaaagtttaaagtgctaaaaaaatcatgcagccctgtttgttaataattgatgttctactagaatacaagctccttgggagccactatgcctaacccactttttttttctttcaattttaagttccggggtacatgtgcaggatgtgcaggtttgttacataggtaaacatgtgccatggtggcttactgcacaggtcatcccatcacccaggtgttaagcccagcatccattagctgttcttcctgatgctctccctcccccatcccccaacaggtgtccagtgtgtgttgttccctgccatgcatccatgtgttctcaccaatcagctcccccttataagtgtgaacatgcagtagttaacctcctttttctatacggttttgtacacagccttccagacaattttgtgctgaaatgtattgctttgttttgttttggttattgtttgtatgttctgaatgccttctgaatatccactgaaaaattaattcccttctggagcgtgaagtacactgaattatacactgattccttgaaacctgataatctcatcatcataccacataatcctctttcaatcagcatattcaattaatgcactatctcatttctcaaatatgctaagttatatctaatctcttagaactggacactacattagagattaaattcaacctgttcactttaaagatgagaaaaatagagatgaatgagctgacaaagtcacacataagtaattaaggacttgcactgttaagttagatagatgtagattagaaggtaaacatcaccatttcttcctgatttttggcaaaccatgtatgtctctaagattgtttcttagctgtaatatgaggataaagcaattaaactttataattattgtaagaaaaaatgaaataattcccataacatattcagcatcgtgcctggcatacaattaatatttttaaaaactattatttttataaatgaaaaacattatttgtaagactacaagcagtgatttcagtcttaggacttccatagagagctgggtgtcccatcattagagctcacctgcaaagcttccgtgcccagagccctcctctcccacctgacaggaagcaaagggaagctccatctttccgtgttggttaattgtggccccggaggttaccatgacttaggaacaacaggacatggggtcgtattgtgtgtgctgggtctccagtgggtctcagagaactcagaggagtgactcttctcctaaaaccttcttgagagacagacttgtgtcaacctgccccaaacactggctttacttcctgatctcagaagggtaagatacacaggtgtgtgtctctcctcagattgtggagttactttgcgccttccagggacccttccctttatgtttatggcctaatggggttgaaggtgccatagtagactctggtagagattgggttgtgtttgttaccctgattttcctcaaaaactcttttgtgggctgaaaggtgtgcttaagctcacctaaagcacacacatggatacacattcctggagcaggtgacttgatggagagcaaggaattgatggaaagagcacataagggatccacgttctatgcacctaggcagggaggcaggctggttgccttgggctgggagaagaggccataaaaaggagggagctagtaaggaggtaaaggggaaactcaaaggggctcagccatcggctggttatgttttaaaccacttatctcaggtgcagcaaaataataccctcagtccaactccgagatttaaaaaacaaaaattaggctgggtgcagtggctcatgcctgtaatcccagcacctttgggaggccaaggccggcggatcatgaggtcaggagatcgagaccatcctggccaacatggtgaaaccccgtctctactaaaaaaaaaaaaaaaaaattagctgggtgtggtggcgcatgcctgtagtcccagttactcaggaggctgaagcaggagaatagcttgaatccaggagatggaggttgcagtgagccaagatggcgccattgcactccagcttgggcaacagagcgagactccgtctcaaaaaaaaaaaaaatgcccggcgtggtggctcacgcctgtaatcccagcactttgggaggctgaggtggggggatcacgagatcaggagatcgagaccatcctggctaacacggtgaaatctcgtctctactaaaaatacaaaaaattagccgggcgtggtggcggttgcctgtagtcccagctacttgggaggctgaggcaggagaatggcctgaacctgggaggcggagcttgcagtgagccaagatcgcgccactgcactccagcctgggcgacagagcaagactccgtctcaaaaaaaaaaaaaaaaaaaaaaaaaaaaaaaaaaaaattgctacactcacagtatcccaggttgcactcagaaagtaacagctccctcccaatagtgattagcttaggggtgtactggggtgaggagcaggtgcaggaccccatagcagagttgagcagggaggtgctgggtgcaacccaggttgtcataatgatgctgcccttgttcacacttgaaatgttttcaaagggcctccaggccccggccagctgtctgctgtcatcccccacacattctgaggcagctccctttcccctcaacacatagaacagagatgatgccatgcttcctataggtgtccatctgatgctcactggaatctccatgagcccccaaagtgtcaggtaacacagctgcaacctccttgaatgaggccattactttgctggtctcctctggtatttaatgaacataggacctggtaaaatcgtgcctcagtttttcctctgggtcacatggtctcgtggtagctcccctccctctgctggggagggcagaggctccctccacaggtgtgtgccagcacctcgtacttacccagctcagtctggagtttctctggaaaaagaacaagaataacatattaaggaatttggtgtaagggaaaggagagaaactattttttaaaaaagaaagcaatttatacattatatagggaagctcaattcattaaaaaaatgaaatgcagaaaaatactgattctttcccacagattacccaatgatacagctttttttccttttctctgcacaacaaaaatgctgtcacttctatctccccatgattctgttggtttcttctgatatttacagcataaatacttagctatcagcatgaaaataacatatgttccttttatagatacacagaaagtacaaaattatatggacataaacagtatcacctaaattacaaagtagagagacgaattatatgtaatatacaatcagcttcatttaaaattaaaatgtaacattaactttaaagtttttttaatctatccatttatatgaataactgtatacttatatccaaatgtggagggtatcctgaaagttttagtgcagttataagttatttaaggccagtaacttttatgtgattggaaatgtcaatttataggtagatgtcatgtttatcattgaatagtgcatcatgaggatttttttcaaccattaaaattatttaaaaatatctttttattaatgctataatgtatagtaagacaagattccacactgtactgttgtattggggggttggttgtttttgctgctatttataaataaggccataattaatattctattatgcaaatagttgtctacatctctgattatcttcatatgatagatttctagaagtaatcagcacaagacagcataggaaaacatttcagttgaagaaatatagctttattttctttacaatgcaatgaatacttgtgagtaaaaacaatcaatgcagaagaaggaaaggtagaactcaaaaataacgcaggcgccataacagctattcaagtaaaatgtagtgcgtatatttccagtcataaatgttttatggctttcaatacatattgctatatgatagataatgtctcttgataaaaatacgaggtgctatggtgcagtccctgggacctctcctgctgatctgagcatgtgggtcctagaggcagagcactgacctgggaggctgatgaccgaccccttctcctcagtgaggacggggttgtggaccaagcaggacacagactctgcagaggcgttcctgaccaccagggtggcttccgcatagaacaggccatctttatcttggatgcgatgctcagacacggccagcagcttctctccccggatgtcttcccaatacacctggggctctgggaaccagccccttgcagtgcacacaagctggactccactctccccaggtccctccatgtggatgctaggggcagaccccagacctgcagagggaagccacagctctgacacccagagcccacagaggcagaaatcacagaggctgagatcccagtgacgttgctcacagggaggtggccggagttcaggagtctgaggagcagaaagtcgacctcagtctccccattcaaatgtgagttcagatacactttatttgttccccagtctgggtctttacattttagcatctgaccagtacttttctccagatccagaaaggggaatcggagaagggggacatcatgacattttgcaacgcctctagcactgcaaacagagatgagctgtaatttattcattaattcctctgtgccatgaactctgcctttttcatcttaaaattatctgtattgggcacattgtctggtattttagatgatgtcttgaactccaatttgattgaagatttaacacaaagtcagaaatcactccccaggggcctgttcttcctgcatcttttgctggtggctgtgatcttcggaagcaagtggataaacgggagcatgtgaaatgcgaatctccacgaggcgttatttgtagctaaatattctattcaatgggtaagatggttttgagaaatcctagtttacaacagtttatgaaatcatgaattttttttctctatttaacgtgaaactcccacacccaaactaaggggactatattttccataaatgggaattctgtcttaatcacttgctggtaaaagagagatccactcccttcccttggacccttagaaaatgtgtgacttatttgtaaatgttcctgatattgaaatacatcagtacgttccctgtccccccatgtcagaaatatatgtattcctccatccattttgaatcaccttgaacacagtaacagtaatggatgttaagaaaaaaaaaggtattaggaaacagcctcccagggaagtaaagaaggaagcagtatcagctggagacgttaacatctccagagaactattttccccatttgccttagtaattggatttacttgattttctctttagagcatggagaagttagccctgtcagggaatcatatgatagtttacttttcataagacagatccattcttcagttgtccccttcttccctactccttcctgcttagctaatacaacagcaatatgaagaaccttcccattcacagagggtgtgtccaaaagcatctgtgagtccccaattcattgaacactagtatataacaatctccaaagcacgacattcttagccttttcagtcttgttgatagctttctaactgagggcatttcacaaggaaagaacattttcacgtctcagtttctgcatagatgggattgggtagagaaaaaccaatgccctgagatacagatgccggacgtcagctgggctcattcatgcagcaattggtttgctcttgcgcaccagccttaggtagcacaaatgtgtgtctcagcaaaattgctaaagactgcatgtcatggattccaaataatcctcaagaacagtcaaaactgtgcaaattaaatttgggaaaatattttaacactaagcttgaagactccagaaccacttatttttaaatcaatcagggtagaggactaagcattaggaattaccttgatgattcaaaaggatttcctcaactgtcacaaagcttaccacaaattaatatatctctgcctcttgagaccctgtgtctttccccagatattcacctgctactttgagcagcaagcttgtttctccacagtagttcccatcctggaaatggcaccagtattgtccattgtcggagggctggatgttgtgtatcttcagtgccacatttccctttgcaatgccattctctatccactctacccagcctctgtactcctccatctgcatctcagtcacctccactccatccctgtgcacaaacacaggtgtgctgggctctgagcggtaccacctcacctccacgtgcattgtggtcctcttggggagtagctggcaggttaacagggcatcttccccaaccccggccaggataggatgagcagggccaatgactctaaagtcttctataaaataagtgaaaaagaggaacgaggaaatgccaatcagaaaatcatatgcatgctttggggtgtccagcctgtcaaaatggaggcaactagaagagggagagatatatgtttaatgttttagagaaatccagcatgatgatttgcacatctgtttgttacagagtcaattttgtgtactgaaaacaaatgcagttcaaaaatgtgggtgaggttgctgtctgtcacctaccagctatgtgattcggtggcaaatctattactcttggtaagattttgagatttgaagtcctaatttcttcatcttcaagatattaataccagcatacctgggttgtttttattctcaagtaaattatttattccttgagtcatttattctcatgtaaattgactttttaaattggaaaccttattcttgttattaacattttattttcctgaagtttagataataaatccatttattagctttttttagcctttcaggattcctcttctcttagatataaaaactgttttttttttgttttttttttgtttgtttttttcccgtctggagttggcaggaggccaattactgggactatgtacaatgcagttttcacaaggacattttgtgctggattaaggacactggtttgtctagagatttttgggtcttccaaacaaattctaagacatgtctgatctcttccttgttatctgcaaattgaagagatgtttaacagttatgtatgttattatgtttgatcattttatgtcatgtatgatatgttctttctcattctaaatgctccggggccatttgctctttctctgtgcagatccaatcctgctaggaagaacctcaccctacttagctgctgctgggtatcaaatagatgctgctcaaaaggtggctaaagagcctaagtggagatctgcttgtattcttcattgatgaagtctaaatatgaagctagaactgaagacattccatcagattgactgttacagggtagggagctgcagcacaagcacagagaagccagcagcttcatcacatcacaccagctctgcagcgccaaggcagacacaccagctctgcggcaccgaggcagacacaccagctctgcggtgccgaggcagagcctgcgccctctgatgctctgtgtcgtgttttttcccacttcgccatgctgcattttccttagggctctgacatctccttctgacactgattttttttttttgacactgaatttttaaataattatttttcaaggtgcaacattttgacgtcaaaattcagctagtgagatttccaaagtccctttcttctaatttcttatttccaagtattttttttaattgcagcttaatttatgataagaagcagctgcatttcttgaccccaaagtactagagtgaattaataatttaacgtggtgcaaccactgattcaagtgcttttaatgtctcatttaatcctaaagcctgtgctggcctctgagatgtagttactgctgttattctcattaaaaagatgaaagaactaaggtatgaggtgctcaagtaactttccaaaggtgactcagctaggagtggaggagctcctgggagtggaggagctcctcaaaagtgaggagttcctttttggatacaggtggcttggccccagacttacactcttagatgttgttctcgacctttggacccagactagctcactgggacattagactatacagtaaagggagaagggaatcctacctgactgcttcattgtcagcaggatgaataggaaggaggcgactgcaccagacagattgtagcctggaaaatccaccatcctccctggaacaaagacaaggaaacgctgtgcctaagtgaggctgtgacacacccggcacactccatggcttccattggttatgcagtcttagcagagaatccacatcaacccctgcacagtcagtgaaatgggcttggctccatttctctgcaattactgatcacatccaaccctttacctaacgtgttatattgtgagacaatgtagcaaatgtaagaagccttgcttgctcatttcggcttgctagcatactttcacaaagcccctgctgtgatgacctgcagttctccagaaagatgcttcaaagacaaaacaagattgagcacacggcctcccatctctcttgcctgagtcactctactccttaaaagataagcaataatagtccttgccttttcctacacataagataacgtctgattgaaggatacctctgtaacctataaccagatctgctcatacacccaaacgttgatgtagttcggcttcaatgtagcttctgagctaatttgatgtagtggttaatatgtaacctcctgacatcgaaaaggatatggatttgtttctgaatcataaagttttactgattgttttgtgcatgaaatattttagtctatatattgtcatctgtgtccaatgattgtaacctctgtattgtaccctccagtgaaaaaagacaactccaatatgaagagcccctttctttctgcctgaacttccttacaaaagccttccaacttgtaacagactttggaccaccctcaacttcgttggtgtgtcttcctacatcagtcctgacatttgccttccaatagaactttatgaaattattcctgcctcagcaaccctaatttcatgagacaatattttaagcaattttttaggtgtaaggaagtcttgtgactgaaatgaaaaaacacttgaggtaaaggaacaataatattaaaaaaaccccaaaccaaaccaaagcaaacaaaactccttaggttcatctgttgtgagcttgcaaaacttatagagcaagattcaaatattttttcctgtcctcctcccaactcctcctgcaaagcctttctttaccactgttttctacacatggaggaaagggcaggaaggctctgcgtctccacactgcagccagaaagccaacattcagtgctagcgctcagagaacccgggacacagagatgccgtggaaagtgaaagaaagagtagtagaaagatagtcgggaaaatatctgtaagtggccttttagaatagacttaaaaacacgaatgaattaaaaaaacaaaaagcccaactggcagaaactggcaaacccagcaaccccactgtcccagctgaacaaaaatacttcacacagctaaaaactttaaaacttaccaggacaaggatagaaggctagttttaccattgaaaaatacaaacttcagagtgaaagaagtctaagacttattatatgtgatgtgtcaagtattttattgaaagaaaacttgcttcacacaaagtagagaaaccagctcaggagcaatgtcaagtcaattacagtttccccctttccaagaaactactgctagtaagattttatgggacaggggtaaaaatcaacattctgaaatggagatttaacaatcaaatgagtcaggagattgttgttacacaaatattgcccatttgctttataaaaaatatgtactttcatataagatatctctaaggaaacttatatgagcccattcacaatacctagatcgaaaagggcagtatgatatttatgtgaaaatggggttgggtgttagaagacagtgcagaccatgagcaccttgccacctgaaacttaccagtcacctccccttagactgaagggtgttgctgatgcctccctgactccttttgtgaaaagcaggaacatttttttccaccaagtaagagtaaagaaagccccacaacatccataccaagcatgatttctcagccttgtgaactaaaatgaactcacacttgctacagaccacttcagaggcttgcgttcctgtaggtctttcatgtcaaagcggtgggagggaaaatctacaagtgaactctcaaaaaaattgctcaaatcaatgaagctttcgaagaatgttgggagaatccatctccagtgctcagatagactgtgagagaatatatcagggaggataaccaccttggaccagggttcttaatgggcaaagaggctgttttgcccttagaggacatttggcaatgtctgggaacattttcagttgtcacgactgggggaggggacatatattgagtagaaaccaggggtgttgctaaacattctatgaggcacgtggcagcccccacaacaaagagtcatccagcccagaaggccggtggtgccgaggaaatgccctgccacagggtttgctgtcaggatgctgaaaagctttggcacattttttgaaaatagataactagacttaaattgccatctttaagtaaaaaccttttaaaatgataagcttttgacccctccgttttactatttggatgtaatgcaagaatcttctgaaactgctgttcctattaaatatagtaaattttggtgttgtcaagatatatgatctaatatgcaaatgtatcatcaaattctcaaaaacccatgtttaatttaatttaattttctggataaagtttaagtgttaaattgtaataataagtggtagcttatgtttaggcattagatgatgaacaattctgaatttcaaggcctatcctgcactgctaaaactcatatcaaagaaaattgcaaattactacgtatcatgcatgggtcattagaacttttttcagtaaaagcctcaaatgttgctcctcaaaatgccaagcagccatagtaactgactggtaagaataaattaacttagttcacgaagttgaaagcttatgtatcttagttcacgaagttgaaagcttatgtatctatgtagacattaaaaacagctatagtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaattaaaaaaaaaaacagctatagtttatcatatgttaaaacaatacatttttatagagaaagctaaaataagatttctaggagacaaagtgaattgggtttttgtgtgtgtgtgtgtgaccttggacatctttctttacttttttgagcctgtattttctctgctgtgtggtggagacaatcatcctaatgttttccaagctgtgtcatgaccatgtgacataagaagacgtcaaggctcagggacacatgccccacatcatccatgacaaatgaaaatgtgatcctggttttctcgtttttaatttcgtgcttcttcctcactcagcctgcttcacaagaacactgtgagggtcaaatgggctacaatcgcactttgaagactgcgcagtgggatataaatgtaagtgggaggcagtgtaacaggtggcagcatttccctaaaggacattgattctgtccgtatgtcctactctgtaatctgagacaatgtccccagcttcccgtggccatccttcaccagggaatccaaaccactcacgtgtctccctctctcctttggggcgaaacctggtgctactgggtcttctcacttagccccagatgtatcttcatccacatagcaggtggtcagaaacaggtcagagccctggggtgtgctgatcaaagacagaactgtgggagagccagagagtgtggaggcctcctccaggactttgggtgaaggaggatttaagccgtctcaccccagttgaaggcagagccaaatcccggaggccctgtgaaaatgagattgcattctgaaaatcagaatagcacattcacctcctaacagctataatcctctcaacagtgaaactccggggacaagtggactttggctgggttcagttgtgaattctgcagacgtgcacacaaaatcatgacactggcaattctcaccttccccagaaagccaaggccttcatggaggcctcatctgcaaccccccagttaggtcctcacacagaccccaccgtcccacacatcagcgggtgctatccacccttccctccaccttgccacacatcaaagattcccaactagtgccaagtctccaccagagcatggcactcatcgggctggagttggaagcaaaactgaatatcaaacgtgccatccctcattccactgatgagaaaacagagacccagagaaaggaactgccctctccaggatcagagctctgggccaaggtcccttgtgggctactttattgctctttttactcaggtactttatctccctttgctgagtaataaaaggtttaattactctcagatgtttaccaaagaaatgtaataaccttctcagcataatatttgggcatgaagagtataatgataggcatattttgtgtgtgtttttgtttctgccagattttcctttacgttccccttaagtctgtgttccttgagctagagggggtctcagatatagtctcaggatttcaagagttctccagaacaatttttaatttaattgcagattttcatgtcaatgtaatgataaaagcatatgcagcattatgatgttacaaggtttgagccgattttttccttaagtttctttccctcccattatgagcagcccataattgggtcccctgacttacggttacgattcttaatgtaagggtttccccctccatccttcagtctagacaaagaccctcccctcactgtagaggatgagagatttggagagaagagaaacataattaaacatggacgaggataggagggtctctttaccctggttctctctcaattggagtagaggggaatgaaccccacttcacctccggttcccagaatggtagcgatgcccacagatgtccctctcagagtggcagcaaaggaaaagttctccaaggcaagaagtggcagactctggaaggctccaacagtgggatgaaagtttgctgcctaaaatgctgggatggaatgttccagcaagaggagagtggcatcaaggacataacagtgatcgtcaccactgtgggaaggacagtgacgaccaggaaacacgacgcgatagtgacatattgtgggagctgatgatgcaaatgtgaggagagacttctacaccagccctgctccgcctcccacctcagaacttagaaatcacacggcaggtgaaggagaggctgctattaaattaattgtgtgaaagcccctgaatttatctggaaattaccagatgaactcctctgtcagaagacataataatgcttggcatacaaattaaaatccgtaataggaaaatatagaaatttactttatacacctgaatgtgtgaaaagatgccgctcattgcatgcattctgtagtatcatctctatggtaccaaatgctgcaattatttgaattttttatggtcagtcacatcagcgccaactcaccgcgtaaagaagctccgtttacactcgcgtgtgtgtgttctcacaaatcatctgcatacactttctcagaggtctgcctgtgctgagaactgtgtcctaaattatgctacatattatgggaggtcattttgtgcaggaagatgttggtgtgtgggagagaaaaaaaggagtcacaatctctgcattctgactagagtccacctccaggagaagcgggaaaacaaggcataagctgctagaactgaggagagggaaaaacaagcatccggcgagggcaggaggaacaggagaggggagtcatggatctgcctggccaccagagggcagcagagacgggctcactgtcggcttcaaggatgttccgcaagtcgattcacttacagactcttcttcaaatgcggcg

SEQ ID NO: 389 - DNA, 1513 bp, Homo sapiens
  cDNA BTNL2-001
agggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctgaaaagagtgaatgtgacattggcttcaaacacagctcacctgagactgatttcttctg

SEQ ID NO: 390 - DNA, 13723 bp, Homo sapiens
  Promoter of CD48
ctgaccaccaggtatggaatacggaattgtaaatgctgagatggggttagaacagcttttgccaaaaggtcccaatctaagggaagtaagtgacttcagtacgaaaagtttgtaaaaccatcttaacataaggagaagtaggaccatactgagtacaagcatccctaaattcttttaaaaaaggtaagattgaacagcgcatatcgatgcagaccggtttaggacccgaaacgacaggagggtgaggggctgtagtggatgggggatggcctggagaatgataggtaaagtgtagtttggtcctggagccattagctgatgctggaggtttgaagagagaagaattagcatatctatggtacatgcagcaaagatccctaccttaacagagcttgcattagagtggggtgaaaaaacgtaagcaatcaacacactaacagaacacactgtatagtatgtaaggagatgataactgccatgacagaggagaaaacctagaataaggtaaggggagtcacaagtactggtaggggcaaaagggtgaacttcatttataaggtgataagtaggtcacatctgagtaaagacttggaggagagaggtggccaagagggtatctggggtaggagggacccagacagaggaaagagccagagcaaaggccctggggcagggatttgcctgccatacataaacaacagcaaggaggtggcgagtgggtagtgtggagtgaacaaggggattgggtgttgagagacacagtcagagagggagtgagattggagagagtagatacattttagctttattaataatgtcttgtcctgtaaaaaaaaaatgctttcctgtaaaagtggctcatgtcttgtgtgtgcatttacaatgtatttagaagcaagttattagaaggtaacaaagtggagactgtataaaccattgtttcacaaagtttggatcagaggcagatttcccgtgaaagtgatgaagctgaagcttcagggcttcttggatggccctggaggagccctagcagtattcatgtaatccattttacaaaacatatcttaaacattaattagaccacagcctctgtctactctaacatccccttcatcacatttctgtttttgttgggtggcatctcagttatgggcattttgaggtctggccaaggggaagtagaaatgggaagtacttagttggggttagcgggatacatgtatgagggttgcaaactcttgtgtgtgaagttcccgctacccacttcagtgaagaaatggcatccaggaatattcttgctgccctctgcactgactcactggcaatggccatggacatgttgcaatcgggctgcaggtgggaagcagaggagaaagcaggttggaagtgaacaacagccagagctattcagtagcaaagtattgtggaagcacgaaggcatttaattaactaaaattatgctgctattttttatgctgtcatgttctttgtagtatttgtatttttttaacctgaactaattccctgggatttctttttttttattctaattgaatttatttttgttcctatttgtatttccagttttgttcttttattatttttctttttcatgagaatactccaaattatataagcctcaggtcatttttaaaaacctggtttggttaagataaggagaaagaaaagatgataaggacaaagtacaagatgaagggaggtccattggtcctttttgtggagggagaacttagaatatgtatacaaaggctaaacaagagctgtggaataaaagctaaaggtagaagaagaggaaatatgtcctatatcactctggtgtcatatgctgccgcacaaaaactcagttgtactcttcaacatgatatatactagctgttcactttccacatatccatcatttccaaaaacattctcaaccactaaaagataaaaatgtctgtgaccccagggctttcaagttcctgttcattcagccttccaaccattcatccatctattcaacaaatgtttattaagcacttaccctgtcctggtttgtacacggaaatacctaggcattcatttctacagtgcttctgattggtccagcccatgccctataatccctctgacagaataagttcaaccctcatacatgtatcccactaaccccaactaagtacttcccatttctacttccccttggccagacctcaaaatgcccataactgagatgccacccaacaaaaacagaaatgtgatgaaggggatgttagagaagacagaggctgtggtctaattaatgtttaagatatgttttgtaaaatggattacatgaatacagtcatcgcacaaccacaacatgcctggcgctgtgctagactctgctgtcagcaaggcagatacagtctctggcctcttggagcatacagcctaggaggacattctttctaggagtttaaaatcactagacatattccagatttgttctccttctgttagttgtttccacatgaattaatagaagcggtcataataggcagtctagatcaatgtttttcagtcttgacattattgacattttgggccacataattcttttttgtagggggctgttctgtgcattgtaagatgtttgccagcattcctggtatctgcccactaggtgccagtaacacttgtccagttgtgacagccaaaaatgtatccagatattgccaaatgtcccttgagggacaaaattctcccacattcaccctggttgagaagtactgagctaggtcatctttggcagactccccaggatgtctcagacttacactcaggaagatagcacaatccactgtctgatgacagaggcaggtagtaacaccagacagatcacttatatatatataattttttttatggagtttcacttttgtcacccaggctggagtgcagtggtgcaatctcagctcactgcaacctccaccccccaggttcaagcaattctcctgcctcagcctcccaagtagctaggattacaggcatgcaccaccacgccgggctaattttttgtatttagtagatacggggtttcaccatgttggtcaggctagtctcaaactcctgacctcaggtgatccacctgcttcggcctcccaaagtgctgggattacaggtgtgaaccaccatgctcagccaatttcagtatattatgagtgctgatgacaggtaagcatacagtattgtatctttcttctctccctccttaaccacccatgtgtaacaattccaaaaaggctgtcctgatggttggctgtaacttcttaccgagaaataaagaagtgattaactgctgataaaatcttgatttgccttcttaacaattccactttttaggaagtagctgaagcaaccttttaaaaaactactattttgatttaattctaacaggaagtatttggtgatatgtctggatgattgggataaagtaacaaagttggatcttattcttttactttcttaatgaactcgctttcacttttaaaaaaaagaagaagaaatagaaccagatcctgtctgtgcccgcccatgtttctagtctgtagaaaaacagaattgtaacgggaaaaaattcagatcaaaggaagtcataatcccaggaccatagagtctccccaggaaagggaaaggttttaaagagtaagttccggttactccaataaaacaagacacatggttggcttctttggtttcctcatatattgagaaaaataaaaataataaaaacaaaacacatggtttctagtaaaactcttaaggaagaaaagaagatgagtgttaaggatgtggagacagagttacctgaagctctctcataagattaaatatttaacaagcctgtacaaccctttttaggaagtaattttgcaatagctaccaagacctcaggtttgtgtcttggtgagaagctgagcaggctactattttttgagatgggaactataatgagttcagtgggcaacactgcaatgcaatctgaaggtgaggaaggagaaacaataaaaatagactcttctcttcagacgttgcaatttgaatgggaaaaagaatggtagggcggtatgtaaagggtcatgaaaaagtagagagtattttgtttttgttattcaagtagggaaagacctaagctatggtaggccaaggaaaggattcagtggagggaagacatgaagagaagggaggtgattgacgagcctgggctagtgggactcagagcagagttagtggcacaggtcttgactgggaggagggacacttcatcctctgagggaaaagagaaggaggaaagacagctggtggtggagaaaagttaccagtttgaagatagtgggcaggaagttgaagggcttcctgcctaatggtctctagtttcgatttcttctgcaaagaaggaggcacatgctttgctgagagggcagaggactgaggtaaggggccttgaggatagggtgaaagtttgaaatagccactgtgggaaatgggagaaagaatttatcagggccagtaagagctactctgagaccccagcttgactgaaacaatgactcaaaatttattccttccttctttcctttgctccctccctccatccacccatccctccatgcatacatgcgtacatgaacttcctcatgtattcactcatcgaataactatgcagtaagcagttactatgtgcttggctctgtaagggtgcaatagatagatgtggctccttcccttgagcttcattccagtgaatcaacaaaattaatcagatgatttcgctattggtgataagtgttaggaaaaggaaaatacggaatgcttagagggcatataaaagggagcacctcacttgaatttgggggttgagaatggcttctgtacgaggaattagcctaagtgggatgaaaccagggaaagatgacgactgggggtagtgaatattccaacaagagggaaaaagaatcaaacgcccagaaacacaaaaatgaaattcatttgcggagtaggaagtagctcactggctaggacatagactaaggagggtagcaagtgagctcattatgaaatgtgaactttaggctcacagcttctgctttctcatttcccacagtggccactaaagattttaagcagaagagtgatgcaaacagagaaccattttagaaaatgtataccgacagcagggtagagaacaggttagctagagagaatgcagtaaatagagcagttaggatagtggatcattgtggaaattggtgataagagaaaatggtggcttgatctgagataggtagcatggggctggatggaattggacatatttgagagatatttttgaaagtagaattaacaggacttactcattgggcatgagaagcaagggagagaaaagaagcaaggatgactcctagaattctggcctgagcaactagacaagtggagatgtcatttatagaggtggggaacagtggaggagcagtaggtttgggggaagaaggattgtagtatttttttttaagtctgtaaattttttgatggtcctctcatcaaatgatggactttgtgccccttcaccttgaaattgagtaggctcggtgatggcttcaatgaatggaatacaccggaagtgtgacctgcaaagctagcttagaaaagaccatgcagcatttgcctatttctcttgggacaccaactctgggaggcttctgctgagtggcactagccacccagcactttgagcctccctctgttcaggcagtagccctgtgagtgaagagccttgcatgactctaggccacaccatgatctgattgcaagcacatgaaaagcacatgaaagtgagacaggatgaacagtcttcccccaaatctgtgggcaaagtaaatcattgttattattttaagccacggtattgtggcagcttgttaaatagcaatacatagcggaaacagagatgatgacttaagttttagacacgtgtctggagagtctagagaagatgtttaagagacagaagttctgatcttgggctcaggagactgcttggggcttaagaatttactgatgctcttcccaggttttcatctgtatcggattccgcatgtgtcacaattgcaaagcaattgcacattttttattttatttgatcttaatagcaaccccttgaagaaatgaggaacagattattatacccattatggagctgaggaagctgaggctcaggaagctttaatgacttgttgaaaattccacagcatggaacccagatagaactaggtcatctcatttctagtacaatactctgtctacttcatcctgctaagtgttgtggacagatggggaattgggtagttgtggagcatgccctaaatcattgccttgaaaccaaagaactgagaaacccaagtctgaggagagaaggaagaagagagctaagagtgcttctcaaagttttccacagaagcatcccttacggcagaggagagaactacttgcacttctcaggaagatatggatgtgtagtccaaaaggaagttttttgaagttgttcattcatttgtgtaacaattatttattgagcacatgccacactccaggcctgtgctaagttcagcagcacaacactgcacatggtttctgtcctcaaaaagttcaaggaaacagatgatccaccaagcaattcacaaaccataatctggagcctgaggttcccatctaaccatgccttcagaacacagtcacaggcagacagtccaagaagaagtcacataaaaacagaagcctaaaagagaggcagggagagggcaggagggagagaaatctaggtggaaagaaggcatgtacataagcccagaggtaagagaaaacgcctcttttaaggcaaacagtaaaattaagagatttagacacattgaccttcaccaagattccctcgccttagtctaggaaaggtataatcataatagaatggtttggaagttagacctgtgtgcccttaggagaatttcttaatctctctgcaagacagtattctcatctgaaaaatgtagataataatagccacctcactattttctaatgaaagttaaatgaaaaagtatgcaaaaggcctagcacaatgtctgacacacagtaagtgcttaatttgtattttactaacccaggttatagcccgggtgttataacccaggtttactaacctcatcaaaaccaatattatccattcaaaggataacataatcaggtgtggtctgattgtttcaaagaagaataaatgaccaagatgaagcctagaaaagaagtcagagaaaggtcaactgtcaggatgttttcagtatgcctagagaaagtcctaaaatattccaattctcattggcaaccctgcttttcccaatagttagatgaatacttcacatcagcccccaatcccaaggtcataccaatgtcctatgcattgagtcaggcccacagaacctatatagccgtagactcacacagtcatgaaccaaaggactctacctgagaggtagaatatgtgagagaccgatcctccacacattctacctcatctccccaaaagttacaaactatcatcattttatgccacagtgtgactaccacatgtttgttgatttttactgttttactcagagtggtgagcattaaagccctttaaattaaaaagacttgagtatttacttgggggaatagcaagaaagtcaaaggtttcactgctgtttctcagctggcataagaagagaggtactggatgaagaaagagggtgaggcagctctaacaggagaaggaaagttagctcagcccttggtcacacaccggggaccgaacaggctgtggcagaggaatggaccttaactcttagcaatcagatgtgttaaggttcctttgatgctgaagcacttccagcctcttctcagaccctcattcagagaccccagacagcaatcctttccaagcttttcttcctataattttgatctatcttttctttgggtcaatgacaatatcatttaccttggctcaggatgcaacacctcacatatacagaggtctcaaagaatgcctaagggagtacagtgtgtctgagcataaaatgcagcagctgtcagtgtagagcttcttcttattcaaaatgaaaaaacaaacacttttccacaacttcatggaccaccaaccacgggacaaaatatgaggagcctacttctcttgctccccaggttcctgttttgatcacatccccgtgggaaaggagatgaagctccattcatcagtgctaagaaaggctccccaaccatgccatggccatgctattggaatggaaatacctgctttccagacaccagatctggcttctagggttgaactacatcccgtctcccctttcccaactgaccatgccttcagtgcacaatcacagatacacagttggtggaaagtaccttgaatgctggtcaccaggagtgacagaggcagcagtagcaattccagagccagacacgaatcccaacctctggagcacatgcttccttccagaacttcccagcaacgcaggagacagttgagagcctggctagaaaaaggccggggctaaaaacggaacttaccaaacagggttagagagaaaaaaaaaaaaaccactgagattttctctccacccagcacacttgtgtggggccccagaaaccagaaaccggaggtcttgtaaatttttttatctaagagcatcacggaaactgagaacaattttgtttgaaggtacatgagtgcttttttgtagggggaagattcatagcttctactgtactctcaggggggccagtactcagaaaagaataagggaccctgatagagaatgtctgcttttcgttcccaggcaggaatccctctgattaattcaggggctaagacataggagcttcccagtcaagcctgggtaggtgtcattcagagcctgaagtctgggaaatcagacccacgtagcctttgtgctgcatatcttacccccagcaccaccctctgctcttcttcctttatgataattcactatttgaagtttgacatcagcctatccactgaacatcagaaaaaaagtaagattacttggcccaaaagaatggatttcccacccttgtagtctgtattagtctgttctcacactgctaataaagacataccccagactgggtaatttataaaggaaagagaggggttttgttttgttttgtttgttttggttttttttttttttgagatgcagtctcactctgtagcccagactggagtgcagcagtgcaatctcagctcactgcaacctccacctgacaggttcaagcaactctcctgcctcagcctcctacatagctgggattacaggcaagcaccaccatgcccagctaatttttgtatttttagtagggtttcaccatgttggcccggctggtcttgaactcctgacctcaagtgatccacctgcctcagcctcccaaagtgctgggattataggcatgggcctgtgcctggccaggaaagtggttaaattgacttctagttcagcatggcttgggaagcctcaggaaacctacaatcatggtgcaaggggaagccaatacgtccttcttcacacggtggcaggaaagagaagcactgagcagcaatggggaaagccccttccttatgaaaccatcagatctagtgagaactcactatcacgagaacagcatgatggtaactgctcgtatgattaacttacttcctactgggttgctcccatgatatgtggggattatgggaactacaattcaagatgagatttggaagggaacacagccaaatcatatcatgtctaggaaatttcaagctcattcctattgaatgtaaattagttatttgcccacccaggacccacaggcaagccacagttcctgatataacatatttgtaatcactttttaattggggacatttctgattctcaacatggagatgaacaataaaatgtctgctcttctcagtcctcaaacctgaaggacattatgttaagtgaaataagtcatgcacagaaagataaaaaaccacgttcccaatcatatatggaagcttaaaaaatgagctcatagaagtagagagtaaaattgtggttatcagaggctgggaagggtagagggaagtggaggatgggaagaagttggttaatagatacaaagttacagctagagaagaggaataagttccagcatcctgtagcactatggagtgaatacagttaagaataatttaatgtatatgttcaaaaagctagaagagaggatttggaatgttcccaacacaaagaaatgatcaatgtttgaggtgataggtatcctaattgctttgatttgatcatcacacattgaatacatgtatcaaaatattactctgtatcccataaatatgtataattattatatgtcaactaaaaataaaagggaaaaaaacataaaagtgaaaagaaagaaccctgcaaataaaatttgaaacagcaccagaatcaaattcctcttggtcaaattgttacactttggaactgtgtgttatatttttcctataaattgatttaaccttaggatacgaccctgctccttcagcaagaaaagataacattgtattagatttttaaaagagaccctgtaaattaatgttacattctcttttttggggggaggggggcacaggctcccactctgtcacccagtctggagtacagtgaccactatgcatggctatttttttaaaattttttgtagagatgaggtctcaccatgttgcccaggccagtcttgaactcctgagccataggatccacactcagtcagtggcaggacggggagtgctgtgacctgcttccaccttgggcaccagtgtctaaatgaagggaacacagtggcactaagaaactcggagatgccagcaactgcggagccctaaggggtgttacagctttgcttggggaatcccaaggcctgagaccccaagaaatgttacagctctctctctcgttcctgccacctgcagctcagcaaatgagggcacctcacagctcttgttcagtcccactgcctgcagctcagcaaatgggggcatgtcacagctcttatttagtcttgctgcctgcagttcagtgaatgggggtgtgtcacagctctcacttggtcccagtgcccacagctcagcaaatacgggtatgttacagcttgttcctgccacctgcagctcagcaaatgagggcacctcacagctcttgttcagtcccactgcctgcagctcagcaaatgggggcatgtcacagctcttatttagtcttgctgcctgcagttcagtgaatgggggtgtgtcacagctctcacttggtcccagtgcccacagctcagcaaatacgggtatgttacagcttgttcctgccacctgcagctcagcaggtcctgggttcttgtcctgcaaccaagaggaataaagcatgcagacaaaggagagtgagtaggtcagagaataattttattgagtgacagaaggaaagctctcagcaaagaggggaccagacagtgggtagaccactgtgtgagaggggccccaaaacaggtagccctctgtgaggctgagtctggggttttcatcggctcagatttgtccataggcaggcctggaaaaagcaccattcgattagctaaaaggtatcaaggaagttctcactctggttgtggactctacccagaactggcagcccagttttcaggctttaaactgtctttgtcttgaaagtctagtttcaccagggacccttttctatctgtccaggaatttgtctgtctcctgtcgctatcactttgggaggccgaggagggcagattgcctgagctcaggagtttgagagcagcctgggcaacatggcaaaaccccatctctactaaaagtaaaaataaaaataaatgttaaaatacctcctttgaatgttgttgtgaaaagttgaagaaaggaaagaacttttatctgaagaatgtgagtccttcaaattatcagagagacatttaaatgagacagaaatcacattttacttccccctactccacctttgggctatgtattcacctcttaaaactacttgctattgctgcaagtaaccataaattaatctaataatgctgcactggacatataacccacaccttacagcttaacaatatgtaaccaatcactaattaatgttatttctgcaaaccaatgagaattccaaaaaaaaaactttgtatcactttttttgcctttaaaaacctgcttgtaacaaaggctgagcagagctcaaaaccaattttacttgggtctgagtcttccaggcagctgtcctccctttggctcaagtaaagtcttcaaatcatattttgtgtttcagcctctttcttttagattgacaagtaaacagctctataattctcaacagtctgcttagatgtgaattaatagccatgggatataggctgatgttaaaacaaaggatgaaatataaacttaagccaaggaatcttcctccttttgcatggtaacagcgggcactgaagtactatgggtgcccattctgaggttcaggactagctagttaggcttctgcatagattcaaaaacaagtctgagagaagtgaccaataaaggctcaaaagccctctccctgccctaagtgaatcagctgttcttgcaccaaagccctggttgcagaaatccctgaagtttgggcatacccagaggtggggctgcaaagaccctagaagatgaagtacaggtcaacaatcctcatgatgtgaattaaaatacacactcttctcagtatctaatctggtgggcacttgacctactgcttgactttgacaaagtgatagtaatgacagaagctattattttctgtgtatctactaagtcaagtacttgccaggacctttgcctatattatctcatttaatcctccaacattttacagaaggatcaggtttcaaaaacaaaaacaacaacaaaacaacaaaataataatcctccaacattcacatgaggatatttataaacactattcttattttacggaagagataactgaggttcagacaagtcaaatggcttgcccaagggcattttgctaattagaaccagaatcaaaattcaaatctacgtctgtctgatgctccagctggcatgcctaactactatgcacacagactctggggttatcaaggttctgggcatcaggggatctgcaatatgcctacaagaaatggagaacacataggaaacactatgagagtcatgccaatgtgaaattaggaactcagagaatatagggccttgagtagcccaaaaatgttcaaggaggggtatggtattgagctgaggatggaagacagacccctggtaggttaagcagggccttgaatgccacaacaggcacagctttgctagtgcctggagagtgagagaaagtgaagtcattccaataaattttccccagaaacaatgagagcaaagataggaacagggtcgatctcccagaagatagaattgatgagaacaggtggctaatgttacagtaggtagtcaggcagacgtgagcagggcaggagagagcctcccacaccaccagcaatgacaggcgac

SEQ ID NO: 391 - DNA, 1125 bp, Homo sapiens
  cDNA CD48-001
gtttggtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattgtcaattaactga

SEQ ID NO: 392 - DNA, 24701 bp, Homo sapiens
  Coding Sequence of the PITX2 Gene
tttgtatgcagtatattttactcccatgaaataaaacacatttgtttcatatttgctgaaaagtaaaacaataatattgtacgaaatgttatacacagggtaggttgtacatagcagtttcagaaacatcattgcatccaccagagaaactattctaaaactgatattcacacattttttataataataataatatgttagaaacatacagtgtggcatttagtatatacactcccttgctcgcaagcgaaaaatcctaatcgcttctgtataacatgctttattttaaagcctaacctttaaaaacactgttgtgatattactaacaactgcttttataaaattaatttgacatttcgatatatatacatcctttcagtcatttaaatgttaacaatgctaaacttaaaaaataacaagcttatagtaatgttaaaatgtcatatccagtcaaacatttgtttgtgtatgtgtccttgcaactgttagaaatacttgtagtgaaagatgtcagacactgaggacatccctttgaaatcaaaggagctctctctttgattcagtggtttccttttctctatatagcttctctttctctccctttctttagtgcccacgaccttctagcataattcccagtctttcaagggcggagttgccccatccggcaaggtcctaggatcccggcgctgtgggtgcggctcacacgggccggtccactgcatactggcaagcactcaggttggaggccgggttctgcacgctggcgtagccgaagctggagtgctgctttgctttcagtctcaggctggccaggctcgagttacacgtgtccctataaacatacggaggagtcggcggcgcgtaaggacaggcaggcgtcggcaccgcggaattcagcgacgggctactcaggttgttcaagttattcaggctgttgagactggagcccgggacgcctgtcactgctgagggcaccatgctggacgacatgctcatggacgagatagagttgggtggggaaaacatgctctgtgatgacagggggttgacgttcatagagttgaagaaggggaagctcttggtggatagggaggcggatgtaaggcccttggcggcccagttgttgtaggaatagcctgggtacatgtcgtcgtagggctgcatgagcccattgaactgcggcccgaagccattcttgcatagctcggcctgctggttgcgctccctctttctccatttggcccgacgattcttgaaccaaacctgggggcggttggggcaagggagcaaacagatgccacagtgcagattactaaaacttccatcggaggccaacccccgccttcccccgacacacacgctagcgcactcacacaccctggcctcgcttcactgcaccgccctgcacaccaagataccagggccagctttcagttactggcccgggtctccaccaagcgcaggagacctggtctgctctggcctgcgagctgggactcggagctacgccacaaacctcagccgaacgcatggagacctgcggacggtttgatcactcagccaggcgtttctccaggtccaaaaacacttaatgtaaaacaaacgcggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccaggagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtccggtggcccagccgcaaccccgatcccaatccacatcgggcctccctgtcgccccagacggcggcttttgtgtattggagagaggcctggcctgagatatccgagctgacaccagtgatgtttcacattacacatctccgccgggcccagccgtgtaatccgctttttctctttttcctttcattcttgatttcctttttatcccccttcctctttgcacccgactgctataaaaagcacgcctcactcccacttggctcgacaagcagccgccctggaaggagaggcagctgcaaggagagcccagcgccgcggctacaaagcactagggtggagctgcggaatagcgggcggggtgggagggcgttttcgaaggatcccagaaaacccatagactctgtctttaattacttgccatttctaccctaggccatctaaactttgctcaggcgagaagagtacgtgagaggcccgttcccttgatgtgcaagagagctaatgaaagactgaccttgctcaaaaccacgccgcccaggacccagctctggctctggacagttaaactaaaaccattttcaacttcttcccggccttttatccaccagcatagcctcatgccttgcacaaatgccacccagagagtgtcttcattccctctgatttgggagagcattttggtctttattctttttatcgttgttttcttctttttgtttgctctgctctaaccgggggctttattttttctacccagagcacttaattttttttttttaacagcaaagcctctggatgccgcttgatttgcttgattctgttttctgcttccagaatcctaacaaatttggaatcttccaccgaccagcataaaccaggacgttgctattgggttatttatttgagctcatttttgccaatccataaagtacagatttgctacaaagttaaggtaagccctttttacaaaactatgattataatttagaagagggggtgtgagtttcaatttccagagttcaactcctgagagaagataaataaaccaagcagaaaagtctttcttctttttttctttctccttctaagaggactagtagttgtgtattaaaactttgctcccggagatcacaaaactaggaaatagggtgtgtgggagagacctgaatggccgaaacaaccgtaaagaaggtgtaagaagcgcgagcccaggagggaaaaagctgggccagggccgggacaaaggtttcccagggagggccaactcttccgtgtctctggcgggttttccttgttaaaggctcacaggttggagcctgttcgcggctcttggcctggtagggattttattagctctgctctggcaactgcaagccaggaacacaatgtcctgtgcaggggattgcccatgcagcccagctcgtgagatcgcgggatggcggggcagtgagccggtgccgctctgggagcctgagccagggcggcagtcctgtcggcctcggagagggaactgtaatctcgcaaccaggccgccgcgaggccttctgcctttgcaaagctgcgccccaccggcgccctcccaggcggcgctgccttccacattctctcctggtctacttggcctgtacctccacaacatcctccccccatccctcccagactccgtgctggctcctacccggactcgggcttccgtaaggttggtccacacagcgatttcttcgcgtgtggacatgtccgggtagcggttcctctggaaagtggcctccagctcctggagctgctggctggtaaagtgagtccgctgccgcctttgccgcttcttcttagacgggtcctcggcgcccacgtcctcattcttcccctgctggcttttatctttctctgaaaacgaaacacacacactttcccgtcagcatgcccacctgcaacgcggacgccaactggaccggcggcagaagccgtggaagagctgggctgcctggcgccggaggagggtgcgcgcggcggctccgggccgcgaggagcgctgcgcctgtggggtgtgcaggcgcaagtgtgggtgtccgcgccccatttcctcccctcccccagcgccgcacgttttatttacatgtttatctcactgcagcggcacattcacttttatagcctgtgctttcaagtatatttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggggcgagagggagcgggtggcgcagagcagctgagcgggaatgtctgcagggcggcgcggcgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggtcgcgctctaggcgcggagtttccccgctgcggggagagccaggggacgcaacccccgccgagttctcaagccaagctgcccccgtctcctccggaaggctcaagcgaaaaagtccggagacggaaagtcagcgggcaaacgaagacatgggatgtgggcagaagggcaccactcagagcgtctttagggagcaggcttccaagctccaaagcgaaacaagagtgggcaaagacccccttcttctctccctccctcccccaagaacccctccaataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgccgcagctcagctccaggcacccaggcgagcgacggaccagatctgcggctccgcgcttccctgttggcctaacatcttaaaaccagaggcgggcttcctggtgccgagacgtcactccgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggagaagagagtggaatggtcaagaagagaaaggtacaaggatcaacaagacacccactctttgtgtctcactacatccatttccaatcccccaccccatataaaaaggagacacgttacttaaaactagaaaatttgaaaaacagcaacaaatcacctctccgatcttaaattttccaaacagcctgtcaagtgaatgctgcgctaatctgaagaagctttaattgcaaagaagacagagccctgaaaaggcaggctaataaattagaaatcgagaagcaaatggacccgtcaaaagaaaattaccttgactttaaacgaacaactgtttggtggttcactctggatttatacaagaataaaaagtcgcctcagatcacgttctctgtgatgcttattagtccccagacagaaaacacacaatagaagagaaaccctaacccagcgttttcaaaatgctgaaagcttatccattctacttaacgttgattaagacacatatcctagatctttcaaattccttgtacactgtattaagctcgtcctaacccgagagagccacgctttaaattcgactctcttgtttactttattatcaatcagatttaaatccataaagcctgtagaatcaacaaccttgagctaattatatatgaaatatgccttaatgaatttccatacaattaagaatgttgccaaataaccaatttcaaggataatttttaacagtcattttcttttcccagtgagctcaaggctgtcttgagccattaaagtccaagcaggcagaaggggtgtgtgtgagctaagggcgaaaagcctagaactgcgctcaactagcaaaagcaaaaccttatttatataaaacaaaaaaaatcacctttggagacatcaactctttatagcactgtttccaagcaaatttaatttccaaagaaattaaagaaagaaatccaaacatattcaaaataatttttgaaagtccttttgtcccccagcataggtcagctggagaggacaaactaatctcctctgggtttctgcatgggcgattgttttactatggagttagtgttatcatctctgaatgtgtatttgtttgacattacagtcaatgatttgcaatgccagcatgaagtatctttaaaacactccctccttgtccttgttcacaagattgggaaacttattcgatgtggaacaaagtggatgaagcagactacaaatatatttgcaacttatgtgtctctcctttgccctgaccacccccaaaccctatctgcaactcctccccattttaaacttgcagtccaaagacgcacatgagaattgtttttcagtctttcttcaccagtatcatcccactttaagaataatttagctgcaagggaggaatttcttcatagtaagctttaaatcagcatttctgcttttaaccttttattccactttaccccattccacacatacagacacctgctcagagtaaaacacatcctcatgtgacaggtctgcattagctgaggctcatacatccagctatattaggtcctgcaatcttatcactaaattatacacattacactagcagcctgttggtaaagaaggttaaattaatttacattctgctcattatctggtgcttaaatgacgcattttatcccggagatttggcggagaatctccttctcagaccccacagcgtttcactgaagacaatgctcttacatttgtagtggtttttaatctgataagactctaatttgcttaagtcttttaaataagggttttaaatgtttctagccgttttcttattgaatttcctctaattcccccaagatcataaagtatatgtgtaaagtaaatatttcctcccattgcactgccagccgatgacctataactaagtcaataagaatccagctcttttctgctgaatgtgtttactaatcatattccagtttcttcttttaaacctcagaatagctgtggtccccacaataccatgccccttaaagcttcatttcatgaagggactccatcacattaaagaatgaaaaaaatctccactgtagttagtatacacagcccctcactccttgtttttcaagattcaaaccccagagctgcaaatatttttggaagcttgggtgttaatgccttattttagaaagccgagaagccccacagagccatatagatttctaaacccatctctcataaacccacagaattttgataaaagctctggtggctccactctaccgatggaactttcatcacgacaaatatacatgtatgaaggacctcaatcagcctccaaagtggttgaaaaacccaagggcacgtgactgctcctcatagtgccaacgtgtgcgagatgttggaagcactggggatcagcagcagcctagatgcctaaaaagataaggtgtcctaatttgtgtggacccattgaagtcaagtggtgaataaagacaattatctagataattcagattaaagtaaaagcaaaaccatatctatttgtatatatatattcacatccattttatattacagacacacacacgcacacacacactggctctgtaaacaactgactcaaagtgaggattttctttgcatttttccagcaggagtttcaacattctcctaatctcctaatcactttacacactcacagcagcggcgattgggtgacattcttctcaggccccctgtgtggcaggacaccaacatgataagtctgcatggggaaaaggaggtatgtggtgggaactaagaaacactgtccagtgaaaactctgtggcatggtggtggttgattttggagatttaatgtacataagacttgtgggtgcacaggcataggcagcatggatgagaaaggggccagaagaaaataaatcttatgcattttgtgattccagcattactgtgacctctggctaagttcttcttaattggttttagaaattactatgagttcagcctctaacacagaaatttccaatacggagaacattggtgggatcctggtagggaaactagaggtgctgcatggctcacgtggggcaaagaaggaaagcccagtgccggcgtgaggttttgagtctgggagacatcaggggttgtctcgattggggtttcttgcttattctttcaaagaaagaccctagaggagggaaatgtgtgacatggggtcagccgtgttttgtgctggtatttgccaccgattaccagtcttaaagtcttatttaatttcacactcttcagtgttagttgtgcaaagtccctctggccatggcagtgagcggttgggctgtgccgccaaactctccgtatcaatctggcctgggactcaaccaagtgatctctgacttttggaaagagtctgtcttcagagttcacccagaagatggcttaattagacatctccctgagctgttaggccttagacgggtgggagtcctgccctgcccaagctagctcaaggacgaggcccgcctggactcagcttggagccacgtgatgggcgtgagtgtgtgagctcctggtaaggcgcagaggtcagatggagaccttgcatcctgcccgagaagtgccccaccccctccaatatctggcttttctctgcatacaaaccaagctgaaaacagtccactacccaccacccctcatagctatggaaccaaataacccagaaattaaaagcttcactgtagctgtccttttccccatttcctaaatggaatttaaaaagctctggcttgtcaaaaggggaagattattttctgaattggaagtctgtagatatattgagcaacagccaccctctctgggtccctgcaaatggtacccatttttccaacccacagctctagctgctcaaccatttgagatttggggtaactacctgggggaacagtgttcagatggcagtgggagttaccacctcacagtggcctggggaagagaagagaaagagattagaggagggggcatttgctaaaatcactcaacgaacatgctgttaatgcttcctcacatttgcatgttactgccacagttttcctaggtgtcactgagtctccagaaagcaactacttgccgaactaagtaaaataaggagaatggtatagcacatgtgtttggagaaggggaaggaagggtggaatatgaaattgagcatagatatccaggtcaggaaagaaggaagtggcaaggggctaaatgaagtcccacccccccgccacttttttaaacaacagttggattaaacactcatctgtcttcctctttttctcttttcttccctctccagcttatgtccatctcccttttctatttcttttgctctcccttctttctgttttctctctcccagacatgctggtagctaacattcagcattagttgtcatggtgaccataaatcacctaaatccaaaaatacccacctataatctgagatgaagcttttatttccctagcgaaataatattttaaaagctgtcagctgacaaaaaaaaaggaacccacctcattgtagtaacccaagtaatatattacttctaaaggtttaaattaaaatgtcagcctgttaaaaacatgctggtagagtcttggacactcttcccgtcagatcctcacaaagaagttgactctgtcattcctggtcgctctttaacatacacacacaattctgtatgctctctccctttctattaatttcttcctcccctaccaactactttagttctcaaagactctacgcattgggttctaaaagaaaagaatctcctcctggatcagaaaacagcctcattggttgctgaagtgaaagatgtggggtttagggggaaaggttattaggaccataatggcggtggtggtaggaggtcatcctagaggagttaagaagaaaaaaaaatgcagggagaaggactggaggtggaaagacagagtaacagaaaactgagctgggtggtcaggtgctgcggtgaagtctagccccgaaatgataggtatatattctcccactcctgcctttttctcctctgagagaaaactttcctagtcagagaccctggggggtaggaggcgggcaaacgccgctgcagttgggccttttgtcttctaccttgggcttgttgtcttttgcctatcttggattacagggtattcgcctagatgaagagccattaattacccattcagtcaatattaggaagacgacaaagctttttacataggattaagaagacatcagattgttccattagtatattcctgctcacgaataagctttcgttatacatttccttttcccccgagccgctctaacaactgctgcatatattagcagcgggcggtgaggaataacagccgaaccagccttaagaaactttgtgtaccgagtcagcagcgaggaacgcgacctgtgaagaccacttttgcgggcagggatccgcagggactgactactttcggacaactggtacaatttcccctgggggtgaaaaaccacaacgcggcggggcacctttcaagtgagctgcagatttgattggcgcggggggtgggggaggggaggggagaatgggatggcggaggtcgggcggaggaaagaaaatggaaaactctccttacccctatttcgttgctttttcctcaagcctcatgcccccttcggcaagcacctgtcccttccgcgctagccacagctagagttctccacctttctctacacatccccttctttctgacaaggctcaggaccttggtcaccaccccacgcaccaccattttgcgttttgctagagacggtctgggctgatctcgctggtgtccatgttaggattaaaatcccttcatgacggcgaggaaaactgtattatttgctttcagggggtacattaggagtccacgtagtatatgctccgcaaacattcgctgattgaatgagaggcgcgggggcggggcggcggagaggggtctgcggccgccaaggccgccagggttaacccaggtccttcgaagaaggttgggaccgagctgctgccgcgtgtgaaggtgtgtgtcgcggctgggggtgccacaacgggccatggagcccacctcccagagggaggaagtctgtgcacaccagcgacttgggtcgaacactttcagcccatccactgggccaaagctatttaacaattaatgcgttcctgggggaggccgggggaagtacccgccccttgtcgggacgcaaagccaggcgtcaggtccaaaggggctgcagtgcagtccgatttcagcacggaacccagagccgccgccctgaaactttttaagccagtgacagaggagggtcagtccgtcctcctcctgagggtgaagaccattttatgagttcctttcaggacccccaaagcaagaaaagccaaagaaaggtctctttgctctagggggtcgttctcagctggcttctacaccatcttctgctagctgcgtccaccctctctcaaacctctggcttttaggggtctccagtcgctctcgtgctacccccgtttcggggttctatccaggctgggcatccgcccaatggataccaaggagaatgggactcactagggaaggaaggcagagcctggactgcttagaggtggactctgcctatacagaacgtttagtctttaacgaggacatggtatttttgggcggcgttgggggcagaggcggagagggtagcgtaatagactatcacggccttttgaagaagtcatatgtcattgtgaactttttttctctttaaaagcaaagaaaaactttaaaaaaacacaagaaataaatccttttgttttacaagcaggctgtggccaggactttggatattccataagttaacttaaaatcagggaaggataggtgctctatccttcagcagtgctatagctttgcccactcgtgtgatttttttttgtcgtctactagttccttaaaagccaattaaatcaagattttcagcatttcttcccattacatgccttttcttaattaatggcattaaacgtgtttaggcagcaatttttcttttcggtcaaaaagtagaaaaagacatattgagtgtaggggaagagcctttcacgtgcactaaaacaatgcgggcctgaaagtaatggttaagaaagcaatcattcattatttctagttctttatgtgctagttatcaaaagcgaacgaccaggggcgcctgcgcggcttgtgactggcgcaagcagaactcctctgctcttagccgtttcctgctcacctacgaggaccccatcctaccgtaggcttctccacctgtcctcagaatgcattccccatgtctaggaaacctggggtagggactgggggaaggagacattttgcgtctctctggctcccagcacaataagaaatgtcagcctcggcttggcgactgcgagcccgccccgcgcgaagcgagattggggagctcctctagtctggccggagccagggctgagcccgcgcaaagcattctccccagaagtcatcgctgctcttgatttttaaccatatcccaaacatactacggtctaataatttatttttactaccgattatcaaacagaagaagaatttaacacaatctaaatgacagaaatcacgcgacgttatctctgcattgcccccatttaaccccatggggttaatcccggacaagtgagcgtttaactggcccagcagggcgactggcggtgtagtgcagtgtccgggcgtgaagcactggatcgctttagacgcttcatttcaacaaatgatcattttctctcagattcacggggaaactccaatgcaagacctttgttttcttcttagtaatacggtttgtttttttgaccggggtcccaaatcgcccccctccatcccatattacatttgtattcttacactttaatccggaaagagggggttaggggccgagggctgtgggggggggggggctttatctgctcacattatcaaaggtcaatagcctcctaaggctaggcacttatttactacggagccaggaaaatagaggaacagtaaatttgaggggtttttttccatgtatttgaaaagaaaggcatcttccctcctccatcccttacacccccccctccgccccatagaacaagtttcaattcaggaaaggcctgtggcgtaggttggagactttttaactttttacataagcctgtagacctcctctggcaatgtccctcgattcctccagagtgaaaccagccaatcaagcaacgacatcgccaaaacccaaggcctggcaaccagtacttcaggcaggttcgcgtcgacaggggcaaacctccattctaccctgggctgctaagcacagtggctgccctccagctcttcagggatgttgtcggccccccgcccctcccccaaccagccaaagcaaaccttcgccaactcaagtttcccttgcttgcctcccgcgatgaaccgcgcacccacaagtctgggtggggcgtggctgagagcctgagtgactgagtgggccctggtggtgctgcgcgcagcgggatataacgagcgacagaggtcgctgttggaccacttttccacgccagcctagacgccgaggtttgctggagcgtgcgcaggggatcagaccacagggagcgagcgagagggagagagaggtgttgggtctcaggagtgcagtataatttggggaaaggaattaacgtccctgggacggctgcttcccgtcccacccagaggcggagtgtctaagttcaagcagcaggcgcgtcaggtctggcggcctcgccttcttgcgcttcgcccgaggcccagagtcccggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgctgcttcctagtccaccgccccgccacagggagaggccactggcgatttggttctgatttccttcctgcccaggctggcccctcggggaagcgcccctcgctggggcctcgccgcagggccagtgccctcttgccgccctcacgtggcgcggcctcccgtccgatgacccgggcaggagaagggggttcttacctaattgcacacacgccgacaccagtttgcggcagttggtctccattccccgttatctgcaaaacagaagagaaggaaggctgtaagaagcggcggccgtcgagtgagcagggctcagatgagactacgttacactagctgttaggcgcctactgtgtgctaggcttcaggcgtgtttttccgacctgacagcctctggctgtgcagcagcatctccagcctagcctcgggcccaggacatttatttatcaagaggggatctccctccagagttgccgcaaaagtgcccagaggttagaggactataaagccacagtgtgctggggaggctgtggacctactttcaagaatctcggtgccggggttaagaactcatctgaacgcaatggcagcgggagtgggtgggtggagaggacttttctctttgggaagctgtatgcaaagaccacccttcagtgcttgtccattagttggagctcggtaaacatttgtagaacatcagcgccaacgtgcccctgtcctagacagcagtttccctcggttttctgtaattctgaaacgaacgggctcttggcctagggtgtttcaggagcgagctgagttcgggcctctcatccatcaggagccacttttccatatttagccacactttctcctagagatactaacccggccatttatttacttactacaaataattaccctaaagtatgatttaagatcgcagaggagagacactgggtggactgagcgagactgaggagagcagggcaaacgttcttggagggtttactgcccgccaaggacggagaaatagctctggtataactgctacccagttctccccctttctctcccgggcgagccaaatctttttcacgttttcaaccacaacgcagcgagccaagcatttaacgcgctcccccttctctgccacaggcaagccgggagaggtgggtctcgaggggctccaccgggtgggtagaagagccgcggttgctttaaagacaagaaaagaaggtccagggctccctaggccccttcgatctcagcgcctgcctctctccacgctaaccagggtacgccgacgaccggagggcccacttcgcgcgggtgcggggatcggggtgggagcaagcgttgtcgggttggcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagatggtaactgcaaatagtttttatttatttattttttttaaagaatgaaatatacaaaagaaaaagattgcgttgcttggtgtaaagtcagtcaattattacacattcttccccccacttccccgtgcttcagtgctgaagaccaaacaaagcaatacaaaacaaatcttcaagaactcatagagctccactctaaggactgaaaagaaggtcaaggcgtgttccttagctcactcctacatgtccttgtgacttggagatttattttgcagtcaaaatgagccttgagacttgcatttttatgcttcatttaatgaccaggcctactagaagaactgagtctaaataactggggaagataattttttaaaaagagacctccaattcccgcctgctgatccttaaacttgccctatcaagacaagtcttctgtgagaaatttggctgccagacttcggaactggcttcaatggctaatctcacaaattgagatgggagacttttcctgatgggaggtagttctcacccccaaagttcatgttctagttggaatgtatatgccaaggactcttgttttggccaacttgggttttatattgtgagcacacaaaaagcactacacggctaacggaggacgaggaaccatggcaaagcaggcaggcaagccctaagaaataaaacaatttgctaaaaaataatttctgatgactaccgcaagactgaaagtgcaggaaaaatacagttcgaataatcccagatcctttcacatttccccccttttcatacactttgttaccccataacaaaatctttaatggaaagtttaaaaataaacagcacaggaacatgtgttttaaatgaactaaattgtgaaattagccagtaaattaatttgtagtaagtaattatttaaggaaattaaaatactgctcagttcagttctgtattttaccatgtgtatgcgttctttacaaccaattaatataagtgctttaggaacatttgaagacaaacacgcttaacttaaggaacaaagcacctaaataatttaagtgtaattttgctgagttaaagtaaaacattccacaaatgaagtggctatttaattttttagggaaagtttggttattgaaatgttgtatgctcatgttacatcaacaaaaatcttcaatttattttgcttatgtgctttgttttcttgatattattggtatttgaattttagatggatttctgccaaaatgatattttgtgtgataaaagcatctttagttttgattgatagactaaaacaaatgcaaggaaatttctttaaatcagattaatttttcataaaaatattttagaatgtatgaattctgatatttacatttataatggtaaaagttttttccgtttagtttagtaagacaatactcacacaaaagagtaaaaaaaaatcacaccaccttatgatagtttgatttctaaattgcttaagaaagtaaagtggttaaactggaaaagaggaacatatttcggaggtttagaatcgaaaatttttttcttaatctccagctggaaaataattctctgcatccatttaaagtgtatctcctgaagtgccagattggagttgactggtgatcaatttaaaggagttacaatccaaagaaatggtgagagcttggcatccaggcctggctcccaggtaattcgcttgggcctgagaggtcactaactgccagttaagatggaatctttttcttttcttttttttcccaatggataacaatgggaagggggctaatcttccagtagctgaaactttgtacccagccctttatcttgagaatgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagagcgaaaggagaggggacctggcggggcacttaggagccaaccgaggagcaggagcacggactcccactgtggaaaggaggaccagaagggaggatgggatggaagagaagaaaaagcaatctgcgccaacccggcagccctaataaatcaaagggggagcgccagggcagcggggagacagaaacgtacttttggggagcaaatcaggacgggctgggaggaagcgacagggaaagtggcccaagagacggaacaaaggacaatgttcatggggttgtttgggacgaggcgtgtggagtgtgggtgtgagcgtgcgtgtgtgaccttctttcaggcctgcagagttgaggaaagaggtcacagcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaaattgcacgggatagaagtgggggtgggggagagagtttccctcaagtccacatttgctcctgcaaagcaaagagtatgtgaaattacagggcatattctcactcgaaaagtgtgccttacttctgaaccctgattttctgatttcttgacttgagcaaagatgtgtattttggtagtgagcagaatattttggctctgtcctgcctctgagtggaaggactataaatataattcgcctggaggaccaggtgtgaaggcttctgccaggcatatgggacaatgttttttcaatctcaagggcatcctgttaatgtatgtttttggaaagtgccggaacacagccattgctcctggattcggattttcccaccaatattaattcctgcttgagagcaaaactcaggcccgctattaaaaagacatctctttggtccctaattgagaataaagttccctctaaaagttgtattgctcttcctaaatcaatataccaatactcgcaattttagaaatatatagtgactcgggagaatgtgcataaaatagatacgtttaaaaaagcttggcgcttaaaactaaccctagtcactatataggtgctgggctttccctacttttgggggctgtctggaacatgttatgtgttttcttgaattactccgtgttttgaattcatttgagttagcagtaaaaacaggcaaacaaacttgctcaatttgttttgagtgctaaatcccttcactttgaaatagctaacagtcgacagatggactcattttatggaaagggttagcctcttcagccacgaagaaaactgattagagatctacattttaagccatttctaacctccacgtaacatccgtgaaaactcaaactttctctctttacccagtggaaactcaaagcagtgttatttaaggggagagaaatgagggggaaaatgcccacgtgctgtttaattgtatttcctctctgactctgagaatttctatttctggtttttgaaatctcgccgaggcaagaaaatcaaatttcttcaacaagtcccacaactgaactctagttacaggacaccggaaagtgcagtccgagaaagacatcttcacctctgcccatcgacgatttttgcagcctccccattcctctgagtaatgggctaataatcctccctttttttcttttcattttgtagagattaagaggcgctcgtagcagaacggccttgccttcagctggtggcgaggataggcaatctcatggaaaagttggaagagaatgagaaaaccaaagacagaaagattcagagatccgcggagagacacagggagagggaagggagttgcgctgaaaagacgcaaagatacgcgcgtgcaactccctcccctttcaggtttcagaggtttgcaaaccagggctgagaggaaggggctcgggaagctcacgttcctctcgccccccttctgtctggagtctcgcccgccagaggctggttaaccccagtcccggccgccgcagacactgcgctgagcttttgggtcctcgccttgcccagcgccagtgcagctgaagtgagcagctggtgggaaatgcaaatggctcctggagaaatagaagatacagaatgattctcattccctcctcgagtgtgtggaaggagctggacatacgtttcacgctcctaatccttcttttacatttttagtcatactcctattaaacaactaattaatgcccagaatcaccagggaatacattaggcatgcaatcgtagaagcagggtgctggggggctacaaaccaccgagctgatttaagacgtggatttcaggtttttcccttgtcaaagcagtaaaggaagagcgggccttggcgactgtatttagattccgattacttcaaattagaagggggtggagggagcgtccaagcaaagcaagcaattctctgccctgcagatgtaaacaagattgtagcatcaaaggtactagctcctttagggctagatcgcctggactgggagcctggggaaggggagacactaaccttacgtatctgtgaatttcaaggatgttacatttttacataaacaactccagtgcggattctctggaatggggggagtaatacccccattctagaatattaaaacattttccccccaaagcgtatatcctttttatttcctcaaaattttgaactatgtctaaagataatagtcttccagtaaactggagcattggaccatttccttcaccctttcctaccgacattttgatgatctgattttaatgtgtggggggcacagggaattaaatacagcccataaaactaagcttagatgaaacagtgctggctaagtgggttcagataatttttaatgagaatctcaattacactcctccccccaatatgttgagacaagtgacagaaccgttagaatggtaatcaaattggaaagctcagggagaacaacaatttcgtgatcaaattggggcaaaaccgtggacaaatgtggggtgacctccgccaactccctgtcacccaagagtcaggatttgggaaaggtacagtattatttcagagcccgctgtgacgggctgtgtgctaccatttactttcttcactctggattatgatctcaaccctggcaagcaatttccccagctccttatctgacaacaagcgagtatgtaaataccaatggctagcgatgtttaactgcctcaaacattattgatttgttggctgttctaaattgtcttcctagtccaggtcttgtttccgaattgtctattctagaggtttgatccatgcctccgatgctacaatacaataattgtttttttaaaaaaggcatttaagatgaaccaattgatttgcatataaattaaaattactatgcgttgccgattccggtgttttataatcatttcgaaattagtacttaaccacttgagctaaaagaatatataaatgcctgtattgactcactaatgaattacccaattaaaacgtccgggcaatgctgggcgctggaaagattgttaaatcaagacatattacaggagggatatgaagattagaaaggtaacagaccaatatctcgcactcaaaacggagtttccggtgattcccagctttaattttggagcaggggtctttctcctctgctgttaaaaagattttgtgcttgtttgtgagtgagtgcattcaagtggaaggaacgctcccacggctacggtggctcaggccctttgctcggaccgggaccttacagttctaacccaggagcgttaaactctggaagactccgggccagccctggaggtgcgtggccccgcaagtcgccaggccaagcttgctttttctgtctgcccctccggcaggctgggcgcgctatggcagtgagctttccgcgcaaacggagagctggaaccaaagctgacatttaatagatatgctaactgagcacttaccttcgtcctgagaataggaataaaaggtagctcttcttaagagaggcggtgcaaaggcacgctataggagttcagaaaaggctggcggcgggaaatctgtagcctgggggctagtcaacatcccctttcatttcaagcacttattgatttgctgttgtcatctttggcgacgcagaaggacacttgaaagaatttctgatggggctctgatctgagaaaggaggtgacctgcccaggctcccaccaaattcttaattaccacatcaactgcttttttttatcccccacccgacctccttccttttgcttattcttaactttttaattattcagaaactcccttacctctcagtggcttcccttctgcagcagttttctattcgaaccttttccccgcctttccgtggtagggcctgtatattgatccctctgacctttggcacatctgggccctctgaaatctctcaatcttttcagatttgaggatggcaggctccaccctctccactgtgtgcacacactcagagatatgaaaacttacacagactgc

SEQ ID NO: 393 - DNA, 7573 bp, Homo sapiens
  Pomoter of PITX2
ccatggggttaatcccggacaagtgagcgtttaactggcccagcagggcgactggcggtgtagtgcagtgtccgggcgtgaagcactggatcgctttagacgcttcatttcaacaaatgatcattttctctcagattcacggggaaactccaatgcaagacctttgttttcttcttagtaatacggtttgtttttttgaccggggtcccaaatcgcccccctccatcccatattacatttgtattcttacactttaatccggaaagagggggttaggggccgagggctgtgggggggggggggctttatctgctcacattatcaaaggtcaatagcctcctaaggctaggcacttatttactacggagccaggaaaatagaggaacagtaaatttgaggggtttttttccatgtatttgaaaagaaaggcatcttccctcctccatcccttacacccccccctccgccccatagaacaagtttcaattcaggaaaggcctgtggcgtaggttggagactttttaactttttacataagcctgtagacctcctctggcaatgtccctcgattcctccagagtgaaaccagccaatcaagcaacgacatcgccaaaacccaaggcctggcaaccagtacttcaggcaggttcgcgtcgacaggggcaaacctccattctaccctgggctgctaagcacagtggctgccctccagctcttcagggatgttgtcggccccccgcccctcccccaaccagccaaagcaaaccttcgccaactcaagtttcccttgcttgcctcccgcgatgaaccgcgcacccacaagtctgggtggggcgtggctgagagcctgagtgactgagtgggccctggtggtgctgcgcgcagcgggatataacgagcgacagaggtcgctgttggaccacttttccacgccagcctagacgccgaggtttgctggagcgtgcgcaggggatcagaccacagggagcgagcgagagggagagagaggtgttgggtctcaggagtgcagtataatttggggaaaggaattaacgtccctgggacggctgcttcccgtcccacccagaggcggagtgtctaagttcaagcagcaggcgcgtcaggtctggcggcctcgccttcttgcgcttcgcccgaggcccagagtcccggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgctgcttcctagtccaccgccccgccacagggagaggccactggcgatttggttctgatttccttcctgcccaggctggcccctcggggaagcgcccctcgctggggcctcgccgcagggccagtgccctcttgccgccctcacgtggcgcggcctcccgtccgatgacccgggcaggagaagggggttcttacctaattgcacacacgccgacaccagtttgcggcagttggtctccattccccgttatctgcaaaacagaagagaaggaaggctgtaagaagcggcggccgtcgagtgagcagggctcagatgagactacgttacactagctgttaggcgcctactgtgtgctaggcttcaggcgtgtttttccgacctgacagcctctggctgtgcagcagcatctccagcctagcctcgggcccaggacatttatttatcaagaggggatctccctccagagttgccgcaaaagtgcccagaggttagaggactataaagccacagtgtgctggggaggctgtggacctactttcaagaatctcggtgccggggttaagaactcatctgaacgcaatggcagcgggagtgggtgggtggagaggacttttctctttgggaagctgtatgcaaagaccacccttcagtgcttgtccattagttggagctcggtaaacatttgtagaacatcagcgccaacgtgcccctgtcctagacagcagtttccctcggttttctgtaattctgaaacgaacgggctcttggcctagggtgtttcaggagcgagctgagttcgggcctctcatccatcaggagccacttttccatatttagccacactttctcctagagatactaacccggccatttatttacttactacaaataattaccctaaagtatgatttaagatcgcagaggagagacactgggtggactgagcgagactgaggagagcagggcaaacgttcttggagggtttactgcccgccaaggacggagaaatagctctggtataactgctacccagttctccccctttctctcccgggcgagccaaatctttttcacgttttcaaccacaacgcagcgagccaagcatttaacgcgctcccccttctctgccacaggcaagccgggagaggtgggtctcgaggggctccaccgggtgggtagaagagccgcggttgctttaaagacaagaaaagaaggtccagggctccctaggccccttcgatctcagcgcctgcctctctccacgctaaccagggtacgccgacgaccggagggcccacttcgcgcgggtgcggggatcggggtgggagcaagcgttgtcgggttggcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagatggtaactgcaaatagtttttatttatttattttttttaaagaatgaaatatacaaaagaaaaagattgcgttgcttggtgtaaagtcagtcaattattacacattcttccccccacttccccgtgcttcagtgctgaagaccaaacaaagcaatacaaaacaaatcttcaagaactcatagagctccactctaaggactgaaaagaaggtcaaggcgtgttccttagctcactcctacatgtccttgtgacttggagatttattttgcagtcaaaatgagccttgagacttgcatttttatgcttcatttaatgaccaggcctactagaagaactgagtctaaataactggggaagataattttttaaaaagagacctccaattcccgcctgctgatccttaaacttgccctatcaagacaagtcttctgtgagaaatttggctgccagacttcggaactggcttcaatggctaatctcacaaattgagatgggagacttttcctgatgggaggtagttctcacccccaaagttcatgttctagttggaatgtatatgccaaggactcttgttttggccaacttgggttttatattgtgagcacacaaaaagcactacacggctaacggaggacgaggaaccatggcaaagcaggcaggcaagccctaagaaataaaacaatttgctaaaaaataatttctgatgactaccgcaagactgaaagtgcaggaaaaatacagttcgaataatcccagatcctttcacatttccccccttttcatacactttgttaccccataacaaaatctttaatggaaagtttaaaaataaacagcacaggaacatgtgttttaaatgaactaaattgtgaaattagccagtaaattaatttgtagtaagtaattatttaaggaaattaaaatactgctcagttcagttctgtattttaccatgtgtatgcgttctttacaaccaattaatataagtgctttaggaacatttgaagacaaacacgcttaacttaaggaacaaagcacctaaataatttaagtgtaattttgctgagttaaagtaaaacattccacaaatgaagtggctatttaattttttagggaaagtttggttattgaaatgttgtatgctcatgttacatcaacaaaaatcttcaatttattttgcttatgtgctttgttttcttgatattattggtatttgaattttagatggatttctgccaaaatgatattttgtgtgataaaagcatctttagttttgattgatagactaaaacaaatgcaaggaaatttctttaaatcagattaatttttcataaaaatattttagaatgtatgaattctgatatttacatttataatggtaaaagttttttccgtttagtttagtaagacaatactcacacaaaagagtaaaaaaaaatcacaccaccttatgatagtttgatttctaaattgcttaagaaagtaaagtggttaaactggaaaagaggaacatatttcggaggtttagaatcgaaaatttttttcttaatctccagctggaaaataattctctgcatccatttaaagtgtatctcctgaagtgccagattggagttgactggtgatcaatttaaaggagttacaatccaaagaaatggtgagagcttggcatccaggcctggctcccaggtaattcgcttgggcctgagaggtcactaactgccagttaagatggaatctttttcttttcttttttttcccaatggataacaatgggaagggggctaatcttccagtagctgaaactttgtacccagccctttatcttgagaatgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagagcgaaaggagaggggacctggcggggcacttaggagccaaccgaggagcaggagcacggactcccactgtggaaaggaggaccagaagggaggatgggatggaagagaagaaaaagcaatctgcgccaacccggcagccctaataaatcaaagggggagcgccagggcagcggggagacagaaacgtacttttggggagcaaatcaggacgggctgggaggaagcgacagggaaagtggcccaagagacggaacaaaggacaatgttcatggggttgtttgggacgaggcgtgtggagtgtgggtgtgagcgtgcgtgtgtgaccttctttcaggcctgcagagttgaggaaagaggtcacagcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaaattgcacgggatagaagtgggggtgggggagagagtttccctcaagtccacatttgctcctgcaaagcaaagagtatgtgaaattacagggcatattctcactcgaaaagtgtgccttacttctgaaccctgattttctgatttcttgacttgagcaaagatgtgtattttggtagtgagcagaatattttggctctgtcctgcctctgagtggaaggactataaatataattcgcctggaggaccaggtgtgaaggcttctgccaggcatatgggacaatgttttttcaatctcaagggcatcctgttaatgtatgtttttggaaagtgccggaacacagccattgctcctggattcggattttcccaccaatattaattcctgcttgagagcaaaactcaggcccgctattaaaaagacatctctttggtccctaattgagaataaagttccctctaaaagttgtattgctcttcctaaatcaatataccaatactcgcaattttagaaatatatagtgactcgggagaatgtgcataaaatagatacgtttaaaaaagcttggcgcttaaaactaaccctagtcactatataggtgctg

SEQ ID NO: 394 - DNA, 16973 bp, Homo sapiens
  Transcription Factor Binding Site within the PITX2 Gene
aaccaaaggagggtgaaatggggcagcccttctgtggaataaaagatgtttcaaccaagttctaatctaatgagttgcaggatgacaatgaaggtgtttctcaactgtacaaggaagagaaatcacattaaaatactgccgagccaataaaaagaggatataacacaagaaaaacaaatgcatttgtgtgaaagatatgtaaagtttagtacatcaactttataaactgtttcagtgttttcttggaacacacaaatttgacaatgtgtgtgagtccacagatggtagtttcaggagaggaggagctttcaaggtgagaatggcaaactggagatttcccactttggtggccataatgccaatggtcatattgcctgggcgaaagaagcctgctcactcactctcccagcctctccagcatgcagtggggctttattaaagagtgtgcacagtcctttttgtgctctgaaaagacaagctatacaatattgcatgctttacttattctaccagaaacttgtattgttcatagaagtactccatattcatacgtacaaatggtttacaggtagactcttgactgaataaaataatgtatcatacctggaaaagtgaacactacaaacaatctgaagccttaattcaaaagaaaggataagcagggcataatccaggagcagccaaaattctggggagagtcacctgatgtagaagaagggcaataataaaaggaggaaatgaagaaggtagaaaataaagggaaggtaaagaaaaggaatggagagagacttcaatttctctcatccatgaagctgtgttgacagctattcctaatccagcattctctgacaaggcattttgtataaatgtggtgtccagcagagactttgtgttgccaggctgctccagccactgtggcctcatcctctctccacctccatggtggcaccccacccagattcctttcttgtcaaacttgtttccagtcacccaagccctctagtctgtgacctcttggtcaaactgtctgttacccaggacacaaatagatcgagggtgtcagataacatggtaatttggtgggggagaagagggtttgagtgaacactgcaataccctttagaatactcctttccccaactactcaaacccttaaaagtaaatgccctttctccacctatgtttctctgtctctaagtcactgaaaagcaactgagcgtgtgattcatacttctttgtatttatttgcttcgatgcattcattgtctctctagagctaacttagtggaacatttgagtcaattctatttttcttgggagagtggaataacataaagttgggtgctgacgaagttgatctgtattgctctgtaggaatgacatagagcattgtgtgcactgcagttagagcagcgacactacatgaagtgatgaacactctgtaaccacatcttaaacagaaagccattttctctgagaacgaactgattggtgatgtccaattaatacacatacacagcacttgtcacattgttgatgcctgctgagactctggaaagccttgtttactgcatgtctccgctgccaccctccatcccctgccagaaattctcaggatcactatacaggctgtgaacacactgaagcaggagcagtggcctttgaagaagctaggatgtgaccttgagagtaatgcaacgatgcagcgttctcagcagacatgcacaccagcacagccactttctcacacccctaagtatagagatttgagtgaatgctctcagcaaaacttctgttccaataaacaagtcagaggtagggtccaggttgaggcggagtgtgccatctgttcaaaatatatatatatatatatatatatatagtgtgtgtatatatatatacagatacacacacactaagaggttataatgagtcaggcatgcatttaaataaaactattttgtataagaaaaaaagaatcttcttaagaggtacaggaattgctctgcaggttggctggcaattcctgaaagccctaataatatcacatctcccttttgcttgcacccaccttatctcagatttttcttcaatgggggcgggggacggggggaacagaggttaggcagagggagagagacagagatacagaaacagaatcatcttcctattcaggaatttgctcagtgcctgagtcagtaatgtttccaggtgagggcacaggaacttaggatgtgcactgtcttgaattcttccttcagctctgttatcttttggtaaattctgtatattttgactgggcacgtgggcctagcacataagtcagtgcagacgtatcattttactttccattacttatgtgtaaagaaaaaacaaataggtcagagtcggaaggaggcagggtccagaccagttgtgggtgggatcggataggagcctaggacttcagcgcgacctcaagccaggacttctgcgaggtctcaggtccgagggccaggtcgggcgccggttgcaccgcccaccgcgcgcctccccttcgtccccaggccctggtccggggctcttgctgccactcccaacccactgagccctgcctcctgggatcccaccccgggcgccagggatggcagcagagcgacctttctcggccctgtggacagccgctcctcctagactccagctttcccccactaacttttataagagatgaaaagctgttcacacgttctcaagtgtgaaagaaaaggaaattctcttgtgttagaagccctgaacctcaaactccgcaaggagaacggttgactcagtcaccccccttcctccagtccctcatttgtcctccgcttcctgcggctgaacggtccttgataagtggcctccagaagattcggtactttgggccaggggcaaggctggggctgctctaggtgcagaactctctataggtcctctctcccaggaccggatagatgattcatttttatacgtaacgttttaccccagtctattcccgcagctggttaatgttcaacccccgggcctcgagaggcagctccaaggaggcaggcaggcatgacccattcaaggtatatggctgctcgggagtgaaggcgcggaggcccgagaaagggtgagaagggatgtggcggggggctcctccggccctggactccctgggtggactagaaaagggcaaagaagtggtcacatctgtgggccagactggtgcgcgatctttggaggcgcagcagcaaggccgcgccagggctgagcccagaccgcccacgaggaggcccgccaggcccggagcagcggcgcgtgcgggggcgtgccgagcgcaggctctagggcccctgcttcgccccagctggaccccgcgggcggtcggtgcagctcgagcgtgtgggctgcgatgccctgcctgagacttcgggctagggatgcgggcgggaagtgggggtgcggcggcagctgcagattagattccttttttttttggccggagggacgtgcaaacttctagtgcccgggccaagagggcgaccccggaggtgcgtaggtggccctccgggttcccgcttctcctagtgcctctgaaaataccgtcagggtaaagggagacaggcagtaagtcttaccaccaccgccctttccccatgtcattggccaaaaactgaacattaagataaagcagctgtttcagtcaatggaaagcggtagggcgaggttgtacccaaaacccggtttagacggccaatgaagtcctaggaaaagccgccccgggggcacgttcaggtggagcggctgcacctcgggtcgttctaagggatgggctgcgtggtacccacggaattcatgggtccaaaaggtcctggtcacctgtccaaacatccatcccctggcgcatggcggttgacaagatggcccggccacccagaggaaggaggatccgggacggggaacttcgcgccgggaagctgtagcccagagctgcagctcagcattcgcaagagattcatcttttttttctctcgtgttcggagaaacagataaacaagacaccgcctcatcagataagaacgtctccttcgatgtcacggatttcaagaggtagctggagaaactgacgtcaggagtgtcctgtgaatgaacatcgcccgaggcctagcacccacagaagaagggttctattttactctactttgcttgatattatttattttctaacaaagtgatccgtagtctgcaaccttaggctctgacaggcaaagcccatttcttagctctggggatggcttgcagggtctccacctctgtccactttggtgtcctctttctcccttcggctccccacctccatcccccgagcccacacacagcggggtgaagctgtcggggagactcgtgggcaaccaaatgcaggcaccctctgaagagacgccgagaaggccctgcattcgatccgggaggacatagaaagatgccatgaagttctattgggtgcagcaagccgttccccacgcacactccccgtgatacctgcccagagaagcagaagcagtttcgagggctgttgacacaggcagagcggggaaacgcgcccaagaattgggctgccactggtatgggtcccaagtcacattcaataagctgcccaccgctttctgggggacagcagtggtggttctaggtctcatctttccagagcgacgaggataaaagttcctgcccaggactgtgtgcgagggggtcccgcactgctgcaaactctcagcggaggcagagaggctttgctgtttctggagagaggaagcattggcagaggcagtctccgggctgtgaggaatccaccctcatgccttagtgtgggtacgtcaggtcccagcatcagcgggccatttcctcagttgcatgaatggaggaaaaaccaaaccaaaccaaaccaaaccaaaccaaaccaaaccaaaccaaaccttggctgtggacaaagaaaacaggagagggagaggatggaggagaaaaagagcacgagggagggcaaacaccttaaacattttttgccgtaagactagaagaactaggtctggaaagatccatcaaagtcccagggtgcagacacacaccctgcccagggagagcccagtgagtctgaacttctcttagtccttctgaaggaaggaaatttaaaaagcacctctcactaccaccaaaaagtaaacacttttaccatgtagtcattacatgtttttgaatttttttaattgtaaggaatttagatggctcttatagccattcttctgcagagtaacttaagcttcaaatagctcctgttttccacaactaccactgaactgtagaaatgtattgttacaaaaggagtagaaatgacttttaaaggtaattaagtataattaaatatatcttcagggggtatttcatttcttgcaggattctctactcttcaaaaaaatctaaaatcaacatttacattttaaaaatgcataaaatactcagcacagaagtgaatgaagttatgcatcccaaacacagtaaattctgctttctatcttttcagatagacagtcaacaatgggaagtcctccctttggggagggggcagggaagggtgggaggggccaagtgtgataaatttttaagattagagtaaaatttccctgggttcatctgctagaacctgaaaaggtaaatcagttacgtgtttacaatggtgtttctacttaacccccttaaaaaaaaaaactcgaattaccattttctcaagttcagttaatgaaatgtttgggaacctggggaagaaaagctatttttaaaaaaattccttctgaaaatctgctaccagaaattcctctcgtttacttccagacttcttcagtcaaccacgtttcttgcttcccggtgtgcttagattaactgcagttcctcagggggtttataaatcaatcaatagggagtctatattcataaaggcctctgatctaattacaccccctccttttttccccctctctaaaaaagttaagtcgcggagccagggactcccagggtagctccgtccactaagggcggctggaggctggggagtcccggcgacggcggcgggggcatccgtggattaggatgtggattgcaggacagacctttgtttggtcacattcgcgacagggattgggggaagggtcgtcctccttcgagatcacgctggatttttatagactcgccttaaaagggctcactcttcacagggttaatttatacggctttcgaggaatattaggacttttaagacgctgtttatattgtcccattaatttttttgttacactcctaacccccacccctacaccccccggcttcagcatctaatagaaagggggtgggggtgagggaaaaagcagggcaaggaggcgaagagaatttgccttctaatcaaactacttactcggcccaggctctccaacatgtttttaaaaattaaatttctaaccaagtcgtaaacactaaaactcagatttaggaattgggaggaaggagagacaatcatgggctgtatacaccttttcccaggtctccactaatctgaaatcggtattagcggaatgaagactttggggccttggaaatttttaaagaggtttactttttttttttttttttaataaaacaaaacccgaggataggccaaagataccgagagaagaaaaggtgcctgctagtaacaggtgagggatggaagggggtggcggggagaaagcccccagacggcggatcgtctgcgcggggttcctgccccaggcctggcgaacctctgagcgctcaaggagcacggcggcagtgcgctgaggccagtgaggcctgggcgcctccgggcccaacctcgagctcgccatttttgaacccaagcggggaaggttggtgctcatgctatagattatgttaaaggttcctttaagcactttaatacacaactagctcagaaatcattaagagacctagagaaggagaaaaaataccctcacactcaccggtaataagtgttgacatgcagcaaaaatcggttgagtggaaccgaggtggtggttgcagcgacggctagagggggacccgtgcaggggcgggaggggcgaggggactgactgcaccggctctgggagctaggtttctctcgctggatgggaaaaggaggtgcggaaaggggcaggcggcctgcgggctagcggggatgagagttgtggggagaacggaggagagagtaaaattattccttttggaagtccaagggaagggagctgaggtgagagaaatggcctctcttaggtcccaagtctccgcccccagcctgcaccactcaagtcggggaagtgacaactcttcctaaacctcgacttccattttttgtttcctgcagattgattgatgtcctcgcgttgttctagttcagcaaccaaactaggccgaggtacacctcttttacccagagctcccaaatcactcaccaacctgcaggagacctaaatcctccgggcaggtctcgttagcgcttccagcccccatccccaaatcccctcttctagctccttccttcccctccgccctttggccctccccgccccctaccaggctgagaggcggagaggccgggaccgctgggccctgcggctccagaagccaaagtccgcccgtggggaccgttttcctctccactgctctcaagtgaacaacatggtgggaggtgaccctcgtccaaagggcttttatctgccccccactgctgcgtgatccctccgcaagtcggaggcagagctttaaaaagaaagaaagtgtgcgttgagcactgatcttaaatcggggacattatctgcgatctctttaagtggcagcagcagtttcttgcagaacaaagactcagtgttcgagctccaaaagcttctaggtaaagtttcattcagatgaaagcaactaaggcgaaaaaacaatgatattgtcggctccagaaaatcggcggttactttttgctctaagttccccagcgtggtgtttgttctcgcccactttggttgtgcggggggttgacaagcataacaaaagatctcagcacatccctccccccacctccacaacgaccctcctagcgccatgaggatgaattctctgggactaagtggtatttgtttctatttgttatgaaatcaaatttcacatttttttaaagctgaaaatcgcggataaagaaggatcgggtgcttaaagttcatttaaacactcacaccgaactcattccctgtttagatgtcagaggatggcagggagggccagggctgtaattcatcttgatttgcttcattgtcctgcagtttgcaaactataatcctgtataatttcaggaacaagcaggtttagaattaatgggtcaatattatttaaaacaaaacaccgggagcatgacctttgcctcaactacatattgctcgacaagactcaggaaactccactctaacctctcaacccctgagttctttgagaaactgaagggctgtagttattagaaatcatctttgtttcttttaatgtctccaaaggatttggaaatagtaatgcaatataacatgaaggatctctctacttaagcctgaagataaacgtggaagcctaaatattttgaactggagatgtttccctgtaaatttattatagatgtattcctcctgagagaaatgcatataaactatacatgtatacatgcacaaatatttctccagaacaatttgctagaggtgtaggtttccccgtaaaggagtaaacttgagagtcattttaagctgatggacttgctaaatttctttcttcttttttctttttcatattatttgctagccataatggaatcctctaggtttaagccaaagaaaaattggagagacaaaattagattttgtagcccttttcccccccgggaatgcctttttttttctttttagtttctgatgaatggctatcatttatttctaccaaatttaaataaggactgctgccttgtatgtttaactaggcaggcagagggaactggtttgtttaggaagcagtgactgagatgtcctggccaagttagtgacagaggaggggagaaagaatccagaccaatttgtatgcagtatattttactcccatgaaataaaacacatttgtttcatatttgctgaaaagtaaaacaataatattgtacgaaatgttatacacagggtaggttgtacatagcagtttcagaaacatcattgcatccaccagagaaactattctaaaactgatattcacacattttttataataataataatatgttagaaacatacagtgtggcatttagtatatacactcccttgctcgcaagcgaaaaatcctaatcgcttctgtataacatgctttattttaaagcctaacctttaaaaacactgttgtgatattactaacaactgcttttataaaattaatttgacatttcgatatatatacatcctttcagtcatttaaatgttaacaatgctaaacttaaaaaataacaagcttatagtaatgttaaaatgtcatatccagtcaaacatttgtttgtgtatgtgtccttgcaactgttagaaatacttgtagtgaaagatgtcagacactgaggacatccctttgaaatcaaaggagctctctctttgattcagtggtttccttttctctatatagcttctctttctctccctttctttagtgcccacgaccttctagcataattcccagtctttcaagggcggagttgccccatccggcaaggtcctaggatcccggcgctgtgggtgcggctcacacgggccggtccactgcatactggcaagcactcaggttggaggccgggttctgcacgctggcgtagccgaagctggagtgctgctttgctttcagtctcaggctggccaggctcgagttacacgtgtccctataaacatacggaggagtcggcggcgcgtaaggacaggcaggcgtcggcaccgcggaattcagcgacgggctactcaggttgttcaagttattcaggctgttgagactggagcccgggacgcctgtcactgctgagggcaccatgctggacgacatgctcatggacgagatagagttgggtggggaaaacatgctctgtgatgacagggggttgacgttcatagagttgaagaaggggaagctcttggtggatagggaggcggatgtaaggcccttggcggcccagttgttgtaggaatagcctgggtacatgtcgtcgtagggctgcatgagcccattgaactgcggcccgaagccattcttgcatagctcggcctgctggttgcgctccctctttctccatttggcccgacgattcttgaaccaaacctgggggcggttggggcaagggagcaaacagatgccacagtgcagattactaaaacttccatcggaggccaacccccgccttcccccgacacacacgctagcgcactcacacaccctggcctcgcttcactgcaccgccctgcacaccaagataccagggccagctttcagttactggcccgggtctccaccaagcgcaggagacctggtctgctctggcctgcgagctgggactcggagctacgccacaaacctcagccgaacgcatggagacctgcggacggtttgatcactcagccaggcgtttctccaggtccaaaaacacttaatgtaaaacaaacgcggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccaggagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtccggtggcccagccgcaaccccgatcccaatccacatcgggcctccctgtcgccccagacggcggcttttgtgtattggagagaggcctggcctgagatatccgagctgacaccagtgatgtttcacattacacatctccgccgggcccagccgtgtaatccgctttttctctttttcctttcattcttgatttcctttttatcccccttcctctttgcacccgactgctataaaaagcacgcctcactcccacttggctcgacaagcagccgccctggaaggagaggcagctgcaaggagagcccagcgccgcggctacaaagcactagggtggagctgcggaatagcgggcggggtgggagggcgttttcgaaggatcccagaaaacccatagactctgtctttaattacttgccatttctaccctaggccatctaaactttgctcaggcgagaagagtacgtgagaggcccgttcccttgatgtgcaagagagctaatgaaagactgaccttgctcaaaaccacgccgcccaggacccagctctggctctggacagttaaactaaaaccattttcaacttcttcccggccttttatccaccagcatagcctcatgccttgcacaaatgccacccagagagtgtcttcattccctctgatttgggagagcattttggtctttattctttttatcgttgttttcttctttttgtttgctctgctctaaccgggggctttattttttctacccagagcacttaattttttttttttaacagcaaagcctctggatgccgcttgatttgcttgattctgttttctgcttccagaatcctaacaaatttggaatcttccaccgaccagcataaaccaggacgttgctattgggttatttatttgagctcatttttgccaatccataaagtacagatttgctacaaagttaaggtaagccctttttacaaaactatgattataatttagaagagggggtgtgagtttcaatttccagagttcaactcctgagagaagataaataaaccaagcagaaaagtctttcttctttttttctttctccttctaagaggactagtagttgtgtattaaaactttgctcccggagatcacaaaactaggaaatagggtgtgtgggagagacctgaatggccgaaacaaccgtaaagaaggtgtaagaagcgcgagcccaggagggaaaaagctgggccagggccgggacaaaggtttcccagggagggccaactcttccgtgtctctggcgggttttccttgttaaaggctcacaggttggagcctgttcgcggctcttggcctggtagggattttattagctctgctctggcaactgcaagccaggaacacaatgtcctgtgcaggggattgcccatgcagcccagctcgtgagatcgcgggatggcggggcagtgagccggtgccgctctgggagcctgagccagggcggcagtcctgtcggcctcggagagggaactgtaatctcgcaaccaggccgccgcgaggccttctgcctttgcaaagctgcgccccaccggcgccctcccaggcggcgctgccttccacattctctcctggtctacttggcctgtacctccacaacatcctccccccatccctcccagactccgtgctggctcctacccggactcgggcttccgtaaggttggtccacacagcgatttcttcgcgtgtggacatgtccgggtagcggttcctctggaaagtggcctccagctcctggagctgctggctggtaaagtgagtccgctgccgcctttgccgcttcttcttagacgggtcctcggcgcccacgtcctcattcttcccctgctggcttttatctttctctgaaaacgaaacacacacactttcccgtcagcatgcccacctgcaacgcggacgccaactggaccggcggcagaagccgtggaagagctgggctgcctggcgccggaggagggtgcgcgcggcggctccgggccgcgaggagcgctgcgcctgtggggtgtgcaggcgcaagtgtgggtgtccgcgccccatttcctcccctcccccagcgccgcacgttttatttacatgtttatctcactgcagcggcacattcacttttatagcctgtgctttcaagtatatttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggggcgagagggagcgggtggcgcagagcagctgagcgggaatgtctgcagggcggcgcggcgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggtcgcgctctaggcgcggagtttccccgctgcggggagagccaggggacgcaacccccgccgagttctcaagccaagctgcccccgtctcctccggaaggctcaagcgaaaaagtccggagacggaaagtcagcgggcaaacgaagacatgggatgtgggcagaagggcaccactcagagcgtctttagggagcaggcttccaagctccaaagcgaaacaagagtgggcaaagacccccttcttctctccctccctcccccaagaacccctccaataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgccgcagctcagctccaggcacccaggcgagcgacggaccagatctgcggctccgcgcttccctgttggcctaacatcttaaaaccagaggcgggcttcctggtgccgagacgtcactccgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggagaagagagtggaatggtcaagaagagaaaggtacaaggatcaacaagacacccactctttgtgtctcactacatccatttccaatcccccaccccatataaaaaggagacacgttacttaaaactagaaaatttgaaaaacagcaacaaatcacctctccgatcttaaattttccaaacagcctgtcaagtgaatgctgcgctaatctgaagaagctttaattgcaaagaagacagagccctgaaaaggcaggctaataaattagaaatcgagaagcaaatggacccgtcaaaagaaaattaccttgactttaaacgaacaactgtttggtggttcactctggatttatacaagaataaaaagtcgcctcagatcacgttctctgtgatgcttattagtccccagacagaaaacacacaatagaagagaaaccctaacccagcgttttcaaaatgctgaaagcttatccattctacttaacgttgattaagacacatatcctagatctttcaaattccttgtacactgtattaagctcgtcctaacccgagagagccacgctttaaattcgactctcttgtttactttattatcaatcagatttaaatccataaagcctgtagaatcaacaaccttgagctaattatatatgaaatatgccttaatgaatttccatacaattaagaatgttgccaaataaccaatttcaaggataatttttaacagtcattttcttttcccagtgagctcaaggctgtcttgagccattaaagtccaagcaggcagaaggggtgtgtgtgagctaagggcgaaaagcctagaactgcgctcaactagcaaaagcaaaaccttatttatataaaacaaaaaaaatcacctttggagacatcaactctttatagcactgtttccaagcaaatttaatttccaaagaaattaaagaaagaaatccaaacatattcaaaataatttttgaaagtccttttgtcccccagcataggtcagctggagaggacaaactaatctcctctgggtttctgcatgggcgattgttttactatggagttagtgttatcatctctgaatgtgtatttgtttgacattacagtcaatgatttgcaatgccagcatgaagtatctttaaaacactccctccttgtccttgttcacaagattgggaaacttattcgatgtggaacaaagtggatgaagcagactacaaatatatttgcaacttatgtgtctctcctttgccctgaccacccccaaaccctatctgcaactcctccccattttaaacttgcagtccaaagacgcacatgagaattgtttttcagtctttcttcaccagtatcatcccactttaagaataatttagctgcaagggaggaatttcttcatagtaagctttaaatcagcatttctgcttttaaccttttattccactttaccccattccacacatacagacacctgctcagagtaaaacacatcctcatgtgacaggtctgcattagctgaggctcatacatccagctatattaggtcctgcaatcttatcactaaattatacacattacactagcagcctgttggtaaagaaggttaaattaatttacattctgctcattatctggtgcttaaatgacgcattttatcccggagatttggcggagaatctccttctcagaccccacagcgtttcactgaagacaatgctcttacatttgtagtggtttttaatctgataagactctaatttgcttaagtcttttaaataagggttttaaatgtttctagccgttttctta

SEQ ID NO: 395 - DNA, 50 bp, Homo sapiens
  Sequence of Binding Site of Probe cg04250930 of the Infinium HumanMethylation450 BeadChip
cgcctctggtccctcagtggcctctgcaaaccctgagccagcctggggga

SEQ ID NO: 396 - DNA, 50 bp, Homo sapiens
  Sequence of Binding Site of Probe cg08025954 of the Infinium HumanMethylation450 BeadChip
cggcatagtacctgttgcccgccatctgagggaggtgcaggtgccaatcc

SEQ ID NO: 397 - DNA, 50 bp, Homo sapiens
  Sequence of Binding Site of Probe cg23763137 of the Infinium HumanMethylation450 BeadChip
agtacctgttgcccgccatctgagggaggtgcaggtgccaatccttcacg

SEQ ID NO: 398 - DNA, 50 bp, Homo sapiens
  Sequence of Binding Site of Probe cg01373166 of the Infinium HumanMethylation450 BeadChip
cgcccaggactcctgggctctgtgtccgcggggccatctagaaacactcc

SEQ ID NO: 399 - DNA, 50 bp, Homo sapiens
  Sequence of Binding Site of Probe cg02237342 of the Infinium HumanMethylation450 BeadChip
gcccgccatctgagggaggtgcaggtgccaatccttcacgtgacgtgacg

SEQ ID NO: 400 - DNA, 50 bp, Homo sapiens
  Sequence of Binding Site of Probe cg20660269 of the Infinium HumanMethylation450 BeadChip
cgtgacgtggctcaccacagcctgtgtacatgtgagcagccgcgtgcaga

SEQ ID NO: 401 - DNA, 50 bp, Homo sapiens
  Sequence of Binding Site of Probe cg12793123 of the Infinium HumanMethylation450 BeadChip
tcacgtgacgtgacgtggctcaccacagcctgtgtacatgtgagcagccg

SEQ ID NO: 402 - DNA, 50 bp, Homo sapiens
  Sequence of Binding Site of Probe cg26001125 of the Infinium HumanMethylation450 BeadChip
cgatggtgccacttggtgtctcctctggcatctgggcaggagacttctcc

SEQ ID NO: 403 - DNA, 50 bp, Homo sapiens
  Sequence of Binding Site of Probe cg15499799 of the Infinium HumanMethylation450 BeadChip
ttggtgtctcctctggcatctgggcaggagacttctccccagaggccccg

SEQ ID NO: 404 - DNA, 50 bp, Homo sapiens
  Sequence of Binding Site of Probe cg26354221 of the Infinium HumanMethylation450 BeadChip
agggaaggcaggaccctggcttcgggcattttctctgctagaatctctcg

SEQ ID NO: 405 - DNA, 50 bp, Homo sapiens
  Sequence of Binding Site of Probe cg25786366 of the Infinium HumanMethylation450 BeadChip
ttacaggtgaggatatgggtcctggaaggtctgcagggaagcccctgccg

SEQ ID NO: 406 - DNA, 50 bp, Homo sapiens
  Sequence of Binding Site of Probe cg27381549 of the Infinium HumanMethylation450 BeadChip
gattttgtattatttcttgttcatatccacctgtccttgtttcatttccg

SEQ ID NO: 407 - DNA, 50 bp, Homo sapiens
  Sequence of Binding Site of Probe cg19855777 of the Infinium HumanMethylation450 BeadChip
cggggttacatctgtgcaaaggctgttggtgcccaggctttggtctgtgc

SEQ ID NO: 408 - DNA, 50 bp, Homo sapiens
  Sequence of Binding Site of Probe cg01954567 of the Infinium HumanMethylation450 BeadChip
cgctagttgagggtgtcagagagaaactcagaggagtagaatccctgggt

SEQ ID NO: 409 - DNA, 50 bp, Homo sapiens
  Sequence of Binding Site of Probe cg18551048 of the Infinium HumanMethylation450 BeadChip
cacaagcataaaattgttggttctctgcatagagtcactggccaaaggcg

SEQ ID NO: 410 - DNA, 50 bp, Homo sapiens
  Sequence of Binding Site of Probe cg24865122 of the Infinium HumanMethylation450 BeadChip
cgtccacagcggagatgtttgtgacccttagcaatgtctgcacgtggaac

SEQ ID NO: 411 - DNA, 50 bp, Homo sapiens
  Sequence of Binding Site of Probe cg16487292 of the Infinium HumanMethylation450 BeadChip
cgcccaaaaaggggatgctgatggaacaagtgacgtccacagcggagatg

SEQ ID NO: 412 - DNA, 50 bp, Homo sapiens
  Sequence of Binding Site of Probe cg22707857 of the Infinium HumanMethylation450 BeadChip
ctttgctggtctcctctggtatttaatgaacataggacctggtaaaatcg

SEQ ID NO: 413 - DNA, 50 bp, Homo sapiens
  Sequence of Binding Site of Probe cg06557067 of the Infinium HumanMethylation450 BeadChip
cggagatgtttgtgacccttagcaatgtctgcacgtggaacagcccgtgg

SEQ ID NO: 414 - DNA, 50 bp, Homo sapiens
  Sequence of Binding Site of Probe cg03036047 of the Infinium HumanMethylation450 BeadChip
cctccatggcacgtggggctgtgggaaccacccatctgaagagcacatcg

SEQ ID NO: 415 - DNA, 50 bp, Homo sapiens
  Sequence of Binding Site of Probe cg13979407 of the Infinium HumanMethylation450 BeadChip
gcatagagtcactggccaaaggcgttaacatcccattatgtcattggccg

SEQ ID NO: 416 - DNA, 50 bp, Homo sapiens
  Sequence of Binding Site of Probe cg26122998 of the Infinium HumanMethylation450 BeadChip
cgatttcagagtggcgggaaggactgagagtcccatttagaaacttccca

SEQ ID NO: 417 - DNA, 50 bp, Homo sapiens
  Sequence of Binding Site of Probe cg23083776 of the Infinium HumanMethylation450 BeadChip
tcaaggatgttccgcaagtcgattcacttacagactcttcttcaaatgcg

SEQ ID NO: 418 - DNA, 50 bp, Homo sapiens
  Sequence of Binding Site of Probe cg06259800 of the Infinium HumanMethylation450 BeadChip
aagtgacgtccacagcggagatgtttgtgacccttagcaatgtctgcacg

SEQ ID NO: 419 - DNA, 50 bp, Homo sapiens
  Sequence of Binding Site of Probe cg04970287 of the Infinium HumanMethylation450 BeadChip
cagcggagatgtttgtgacccttagcaatgtctgcacgtggaacagcccg

SEQ ID NO: 420 - DNA, 50 bp, Homo sapiens
  Sequence of Binding Site of Probe cg14945317 of the Infinium HumanMethylation450 BeadChip
cgtcgtccgaaggtctggcactgagtatctgcagggtcagtctgccctcg

SEQ ID NO: 421 - DNA, 50 bp, Homo sapiens
  Sequence of Binding Site of Probe cg11334097 of the Infinium HumanMethylation450 BeadChip
tccctgggtgtcctgaaaaccagctttgcagaggatagcaggagacctcg

SEQ ID NO: 422 - DNA, 50 bp, Homo sapiens
  Sequence of Binding Site of Probe cg17411913 of the Infinium HumanMethylation450 BeadChip
agcgtgcgtcccagcgagtcagctccacttgatcggcagtttaaagcccg

SEQ ID NO: 423 - DNA, 50 bp, Homo sapiens
  Sequence of Binding Site of Probe cg14522427 of the Infinium HumanMethylation450 BeadChip
cgtgggtggggagccagcgtgcgtcccagcgagtcagctccacttgatcg

SEQ ID NO: 424 - DNA, 50 bp, Homo sapiens
  Sequence of Binding Site of Probe cg20975414 of the Infinium HumanMethylation450 BeadChip
cgtgagcccccagtctgagaacaagaaagaagaacttctgtctcgaggta

SEQ ID NO: 425 - DNA, 50 bp, Homo sapiens
  Sequence of Binding Site of Probe cg23598352 of the Infinium HumanMethylation450 BeadChip
aacttccccattcctggcaaagtcatttcccaaagtctgggaatattccg

SEQ ID NO: 426 - DNA, 50 bp, Homo sapiens
  Sequence of Binding Site of Probe cg14025883 of the Infinium HumanMethylation450 BeadChip
atgcgactcatctctaacagcagaccagaacctgcctgaggttaggagcg

SEQ ID NO: 427 - DNA, 50 bp, Homo sapiens
  Sequence of Binding Site of Probe cg20856453 of the Infinium HumanMethylation450 BeadChip
tccgggagccgagggttttccccgccagggtcaggcctgggggcggggcg

SEQ ID NO: 428 - DNA, 50 bp, Homo sapiens
  Sequence of Binding Site of Probe cg15484899 of the Infinium HumanMethylation450 BeadChip
tgggaggttagcggggtctcgggtcctgcagaggaaaacgcccagctccg

SEQ ID NO: 429 - DNA, 50 bp, Homo sapiens
  Sequence of Binding Site of Probe cg10586317 of the Infinium HumanMethylation450 BeadChip
cgttactgcccatgagcttatcctctgagtgggtggcgacttctcattgt

SEQ ID NO: 430 - DNA, 50 bp, Homo sapiens
  Sequence of Binding Site of Probe cg24779170 of the Infinium HumanMethylation450 BeadChip
cggccagaggccagtaggatcttacttagtgagatcctgcatgtcacacg

SEQ ID NO: 431 - DNA, 50 bp, Homo sapiens
  Sequence of Binding Site of Probe cg16909402 of the Infinium HumanMethylation450 BeadChip
cgtccttcttcacacggtggcaggaaagagaagcactgagcagcaatggg

SEQ ID NO: 432 - DNA, 50 bp, Homo sapiens
  Sequence of Binding Site of Probe cg24154340 of the Infinium HumanMethylation450 BeadChip
cggtggcaggaaagagaagcactgagcagcaatggggaaagccccttcct

SEQ ID NO: 433 - DNA, 50 bp, Homo sapiens
  Sequence of Binding Site of Probe cg05200628 of the Infinium HumanMethylation450 BeadChip
cggaaactgagaacaattttgtttgaaggtacatgagtgcttttttgtag

SEQ ID NO: 434 - DNA, 50 bp, Homo sapiens
  Sequence of Binding Site of Probe cg06045968 of the Infinium HumanMethylation450 BeadChip
ttagagcctctgccttactgccaccagttgctggactataaagtcaggcg

SEQ ID NO: 435 - DNA, 50 bp, Homo sapiens
  Sequence of Binding Site of Probe cg06300880 of the Infinium HumanMethylation450 BeadChip
gtttgcacaggtggaacctgacagcaccttgcatgggttgcagtgagccg

SEQ ID NO: 436 - DNA, 50 bp, Homo sapiens
  Sequence of Binding Site of Probe cg21572897 of the Infinium HumanMethylation450 BeadChip
gcttgagtgtcctctttggagaccaccctagagctagagttccagccacg

SEQ ID NO: 437 - DNA, 50 bp, Homo sapiens
  Sequence of Binding Site of Probe cg11874272 of the Infinium HumanMethylation450 BeadChip
cgaggaaatatcttctagtatagtttctgcttgattaattctatgtttgt

SEQ ID NO: 438 - DNA, 50 bp, Homo sapiens
  Sequence of Binding Site of Probe cg16331599 of the Infinium HumanMethylation450 BeadChip
ccgagggtacgtttgtagtcattctcatcagtggaaatgcccacctgccg

SEQ ID NO: 439 - DNA, 50 bp, Homo sapiens
  Sequence of Binding Site of Probe cg09644952 of the Infinium HumanMethylation450 BeadChip
cgagtgaaacctgtccccgctgaagcactaggtttggagaaatctactgg

SEQ ID NO: 440 - DNA, 50 bp, Homo sapiens
  Sequence of Binding Site of Probe cg01436254 of the Infinium HumanMethylation450 BeadChip
tggatggggctccctttgggggtttcccagggctttacactcatgctccg

SEQ ID NO: 441 - DNA, 50 bp, Homo sapiens
  Sequence of Binding Site of Probe cg04387658 of the Infinium HumanMethylation450 BeadChip
cgccagaaggtttctccatgctgtggagacttcctggaaggagtcacacc

SEQ ID NO: 442 - DNA, 50 bp, Homo sapiens
  Sequence of Binding Site of Probe cg18995097 of the Infinium HumanMethylation450 BeadChip
tgcctgattctcctgcctcagtctgtcgaatgcctgcgattgcaggcacg

SEQ ID NO: 443 - DNA, 50 bp, Homo sapiens
  Sequence of Binding Site of Probe cg13053992 of the Infinium HumanMethylation450 BeadChip
cggtggctggttcagatcccaactccggagctgtgtgaccccagaaagtt

SEQ ID NO: 444 - DNA, 50 bp, Homo sapiens
  Sequence of Binding Site of Probe cg24838349 of the Infinium HumanMethylation450 BeadChip
aaaccctcattcctcccttgactgattcaccacttgaacctcatatgacg

SEQ ID NO: 445 - DNA, 50 bp, Homo sapiens
  Sequence of Binding Site of Probe cg09031938 of the Infinium HumanMethylation450 BeadChip
ctgttaccagtggggaaaccgaggcatgccacctgtgagagtcttgtccg

SEQ ID NO: 446 - DNA, 50 bp, Homo sapiens
  Sequence of Binding Site of Probe cg16873443 of the Infinium HumanMethylation450 BeadChip
cggcccactctggggacctcgtgtgtggggagtcacacagtgtttgtcct

SEQ ID NO: 447 - DNA, 50 bp, Homo sapiens
  Sequence of Binding Site of Probe cg14453145 of the Infinium HumanMethylation450 BeadChip
gtgccagggtggggtggttcagggggtccagtgcctgggcctggctggcg

SEQ ID NO: 448 - DNA, 50 bp, Homo sapiens
  Sequence of Binding Site of Probe cg18096388 of the Infinium HumanMethylation450 BeadChip
cgcctgtgggatctgcatgcctggagcagccccaccagagtgccgccttc

SEQ ID NO: 449 - DNA, 50 bp, Homo sapiens
  Sequence of Binding Site of Probe cg10057601 of the Infinium HumanMethylation450 BeadChip
tgagtcctgtggtggggctgtgcctggtgcaggtgcaggctggagccccg

SEQ ID NO: 450 - DNA, 50 bp, Homo sapiens
  Sequence of Binding Site of Probe cg25372407 of the Infinium HumanMethylation450 BeadChip
cgtgccacctgctccgcctccttcggcctgcaatggttcattctgtgtca

SEQ ID NO: 451 - DNA, 50 bp, Homo sapiens
  Sequence of Binding Site of Probe cg01889010 of the Infinium HumanMethylation450 BeadChip
cgctctcacagccctggccagtggcaccggcagtgcccctccggccacac

SEQ ID NO: 452 - DNA, 50 bp, Homo sapiens
  Sequence of Binding Site of Probe cg02122525 of the Infinium HumanMethylation450 BeadChip
cgtggcccccacgccctaccccgtgggggtctccccagctcagggcccct

SEQ ID NO: 453 - DNA, 50 bp, Homo sapiens
  Sequence of Binding Site of Probe cg06386983 of the Infinium HumanMethylation450 BeadChip
gtgtgtggggagtcacacagtgtttgtccttttgtggcttgtgcccctcg

SEQ ID NO: 454 - DNA, 50 bp, Homo sapiens
  Sequence of Binding Site of Probe cg16720890 of the Infinium HumanMethylation450 BeadChip
tgttggagaagctgcaggtgaaggtggcgttgtccccttcggtcaccacg

SEQ ID NO: 455 - DNA, 50 bp, Homo sapiens
  Sequence of Binding Site of Probe cg11036279 of the Infinium HumanMethylation450 BeadChip
gtgtgggagcccttccttcctgaggtgactccctctgtgcggaatcaccg

SEQ ID NO: 456 - DNA, 50 bp, Homo sapiens
  Sequence of Binding Site of Probe cg03903296 of the Infinium HumanMethylation450 BeadChip
acgagtgtcaggctgcggacaccttgctcttatctttcccgcctgggtcg

SEQ ID NO: 457 - DNA, 50 bp, Homo sapiens
  Sequence of Binding Site of Probe cg09319815 of the Infinium HumanMethylation450 BeadChip
agtcacgcccgttgggcagttgtgtgacacggaagcggcagtcctggccg

SEQ ID NO: 458 - DNA, 50 bp, Homo sapiens
  Sequence of Binding Site of Probe cg15153118 of the Infinium HumanMethylation450 BeadChip
cgagagggcaggctctgtttaaaagccactcggtcggcggagctttgtca

SEQ ID NO: 459 - DNA, 50 bp, Homo sapiens
  Sequence of Binding Site of Probe cg25890838 of the Infinium HumanMethylation450 BeadChip
cggaagggaaactgtcccaggtcaggttgaagggagggtgcccgcccctt

SEQ ID NO: 460 - DNA, 50 bp, Homo sapiens
  Sequence of Binding Site of Probe cg21855211 of the Infinium HumanMethylation450 BeadChip
agatgggccccgtgtgctggaacatgagccagcagcgatggaaagtggcg

SEQ ID NO: 461 - DNA, 50 bp, Homo sapiens
  Sequence of Binding Site of Probe cg24984297 of the Infinium HumanMethylation450 BeadChip
cggaggaacctgctggcccagaccagacccggcatctctgaccgtggtcc

SEQ ID NO: 462 - DNA, 50 bp, Homo sapiens
  Sequence of Binding Site of Probe cg11532131 of the Infinium HumanMethylation450 BeadChip
cgcctgtaccttcccacccaggccctggtgggagcccggccaaccccttt

SEQ ID NO: 463 - DNA, 50 bp, Homo sapiens
  Sequence of Binding Site of Probe cg22870429 of the Infinium HumanMethylation450 BeadChip
atactcatccattagacagcctgatacaggcctgtagcctcttccggccg

SEQ ID NO: 464 - DNA, 50 bp, Homo sapiens
  Sequence of Binding Site of Probe cg19421218 of the Infinium HumanMethylation450 BeadChip
aacattaagacagaacttaaaaacaatagattgactataatccaaagacg

SEQ ID NO: 465 - DNA, 50 bp, Homo sapiens
  Sequence of Binding Site of Probe cg20832020 of the Infinium HumanMethylation450 BeadChip
cagaagaggccacatctgcttcctgtaggccctctgggcagaagcatgcg

SEQ ID NO: 466 - DNA, 50 bp, Homo sapiens
  Sequence of Binding Site of Probe cg22577252 of the Infinium HumanMethylation450 BeadChip
cgagtagaagatctccttcaagggaaagttgctgtgtttgtccaagacct

SEQ ID NO: 467 - DNA, 50 bp, Homo sapiens
  Sequence of Binding Site of Probe cg26785823 of the Infinium HumanMethylation450 BeadChip
cgggtacaaacccaaacagtgcagacatggaggagacagaaggtgaaaat

SEQ ID NO: 468 - DNA, 50 bp, Homo sapiens
  Sequence of Binding Site of Probe cg21212624 of the Infinium HumanMethylation450 BeadChip
agtgcacacacaggaacgtgaaatggctgagccggcccagagaggcagcg

SEQ ID NO: 469 - DNA, 50 bp, Homo sapiens
  Sequence of Binding Site of Probe cg01071346 of the Infinium HumanMethylation450 BeadChip
ttcctgcagtcggcccaggcaggacctgagcagcctgaagccatgagtcg

SEQ ID NO: 470 - DNA, 50 bp, Homo sapiens
  Sequence of Binding Site of Probe cg06239131 of the Infinium HumanMethylation450 BeadChip
gaaacgccacagtgggacctcctggatcaaatagtgcaatgatgtaaacg

SEQ ID NO: 471 - DNA, 50 bp, Homo sapiens
  Sequence of Binding Site of Probe cg25033759 of the Infinium HumanMethylation450 BeadChip
cgatgaaacgccacagtgggacctcctggatcaaatagtgcaatgatgta

SEQ ID NO: 472 - DNA, 50 bp, Homo sapiens
  Sequence of Binding Site of Probe cg25725823 of the Infinium HumanMethylation450 BeadChip
agggggcggcgtttatagcaccttgtcccatgggggccccttggagggcg

SEQ ID NO: 473 - DNA, 50 bp, Homo sapiens
  Sequence of Binding Site of Probe cg15706223 of the Infinium HumanMethylation450 BeadChip
cgccccgtgctgtgccatgctcgggtttcaagagcccacagccagttgga

SEQ ID NO: 474 - DNA, 50 bp, Homo sapiens
  Sequence of Binding Site of Probe cg04343794 of the Infinium HumanMethylation450 BeadChip
cggggaaaccaggctggcggggatcagaaaggttttctatgcaaagtctg

SEQ ID NO: 475 - DNA, 50 bp, Homo sapiens
  Sequence of Binding Site of Probe cg07671976 of the Infinium HumanMethylation450 BeadChip
tctatgcaaagtctgcggccacattggtgtccccagtgcagggggcggcg

SEQ ID NO: 476 - DNA, 50 bp, Homo sapiens
  Sequence of Binding Site of Probe cg14886269 of the Infinium HumanMethylation450 BeadChip
cgcccatcgccccgtgctgtgccatgctcgggtttcaagagcccacagcc

SEQ ID NO: 477 - DNA, 50 bp, Homo sapiens
  Sequence of Binding Site of Probe cg02709725 of the Infinium HumanMethylation450 BeadChip
cgggcacccagggcccggtctctcagagccaccttcatccgtcacaccag

SEQ ID NO: 478 - DNA, 50 bp, Homo sapiens
  Sequence of Binding Site of Probe cg00086243 of the Infinium HumanMethylation450 BeadChip
cggctcagcacaccccacctggctggcttcaggtgtgaaactcaccatgg

SEQ ID NO: 479 - DNA, 50 bp, Homo sapiens
  Sequence of Binding Site of Probe cg21616720 of the Infinium HumanMethylation450 BeadChip
tggctaacatggcgaaatcccgtctctactaaaactacaaaaattattcg

SEQ ID NO: 480 - DNA, 50 bp, Homo sapiens
  Sequence of Binding Site of Probe cg23867494 of the Infinium HumanMethylation450 BeadChip
ctgagcacggcaggtgtctatggctgaactgtgccccttaaattcctgcg

SEQ ID NO: 481 - DNA, 50 bp, Homo sapiens
  Sequence of Binding Site of Probe cg16252905 of the Infinium HumanMethylation450 BeadChip
cgttcacaagggtttcccactgacagtgagaaaaagcttacatttgcaat

SEQ ID NO: 482 - DNA, 50 bp, Homo sapiens
  Sequence of Binding Site of Probe ccg09586191 of the Infinium HumanMethylation450 BeadChip
gaggaaggtggcaggccggggaccctggctgtgggctgggcacaaaggcg

SEQ ID NO: 483 - DNA, 50 bp, Homo sapiens
  Sequence of Binding Site of Probe cg17084044 of the Infinium HumanMethylation450 BeadChip
cgcaggcaggtttccaccttctatgcaaacagttctcaggttccaggttt

SEQ ID NO: 484 - DNA, 50 bp, Homo sapiens
  Sequence of Binding Site of Probe cg21815220 of the Infinium HumanMethylation450 BeadChip
cgggcacgcaggcaggtttccaccttctatgcaaacagttctcaggttcc

SEQ ID NO: 485 - DNA, 40005 bp, Homo sapiens
  region between coding regions of CD274 and PDCD1LG2
tacttggaatatttgcagccttgttcctagttcttttttcattgcttatacagcatgtttttatacagcatgcttttgaatcctgcacaatgaaaaaagtatcaaaagattttattttaaaaaagaatgtattgaaaattttcattctctctcattcggcagcttcctttaggaccataccaagaagagtcaaaatcctgtcatctacattgaagatctaagggagagagggtgggagagaaggagtggaacccaatagaactatagggaaacaaagggacttacctctaagaaagtacttttcccagatctgtaaacgggtatgcaatccagtgtgtaggaagatagatgtattgcagtcttcaagttttgaaaataaagcgaggaaactagaactaagccaagttgaggattaagggctagcaatggttaggaccatagatctgtggttttaaacaagcatgacaaaacttatcattcaaggaagtatagaccttttaatgtgtcatccggtgagattttagtcatgaaattccattttaaaagactatcacttatttgaatcagatactcttaaaggattataatggctatttctaagaatatgtgtttgactctagatgcttttgtttgtttgtttttgagacagagttttgctcttgtcacccaggctggagtgcaatggcactatctcagctcactgcaacctccgcctccaggttcaactgattctcctgcctcagcccctcgagtagctgggattacaggcacctgccaccactcctggctaatttttgtacttttagtagagacagggtttcacaatgttggccaggctgatctcgaactcctgacctcaggtgatccacccatctcagcctcccaaagggctgggattacaggtgtgagccacggtgcctggcctctggatgttttcagtagtaatgatgatgcactatttatgctagcccttgggcagtcaaagcaataaaaatgtgtgctagacatcaagatatctggccttcctaatcaggaaaggatatggagaactagtcttcctggcttgccttggtggtatggaaattttgtgacacttgaggggtctgtattatagaaaagttaatatgaaaatggttcataagctttcattaaacttttgttctagtcccttttacaagtgtgtgcctgtctgccacaagtaggcctaatatattttttaagttttatttttaattgacatataattgacttttttttattattatactttaagttctagggtacatgtgcacaaaatgtaggtttgttacatatgtatacatgtgccatgttggtgtgctgcacccattaactcgtcatttacattaggtacatctcctaatactatccctccctcctccccgtaccccacgacaggccccggtgtgtgatgttccccatcctgtgtccaagtgttctcattgttcatttcccacctatgagtgagaacatgcggtgtttggttttttgtccttgcaatagtttgctgagaatggtttccagcttcatccacgtccctacaaaggacatgaactcatccttttctatggctgcatagtattccatggggtatatgtgccacattttcttactccagtctatcattggtggacatttgggttggttccaagtctttgctattgtgaatagtgctgcaataaacatacatgtgcatgtgtctttatagcagcatgatttataatcctttgggtatatacccagtaatgggatggctgggtcaaatggtatttctagttctagatccctgaggaattgccacactgtcttccacaatggttgaactagtttacactcccaccaacagtgtaaaagcgttcctatttctccacatcctctccagcacctgttgtttcctgactttttaatgatcgccattctaactggtgtgagatggtatctcattgtggttttgatttgtatttctctgatggccagtgatggtgagctttttttcatgtgtctgttggctgcataaatgtcttcttttgagaagtgtctgttcatatccttcacccactttttgatggggttgtttgattttttcttgtagatttgtttaagttctttgtagattctggatattagccctttgtcagatgggtagattgtaaaaatgttctcccattctgtaggttgcctgttcactctgatggtagtttcttttgctgtgcagaagctctttagtttaattagatcccatttgtcaattttggcttttgttgccattgcttccagtgttttagtcatgaagtccttgcccatgcctatgtcctgaatggtattgcttaggttttcttctagggtatttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtggatgtgtggtattatttctgagggctctgttctgttccattggtctagatctctgtttcagtaccagtaccatgctgttgtggttactgtagccctatagtatagtttgaagtcaggtagcgtgatgcctccagcttttttcttttggcttaggattgtcttggcaatgcaggctcttttttgattccatatgaactttaaagtagttttttccaattctgtgaagaaagtcattggtaacttgatggggatggcattgaatctataaattaccttgggcagtagggccatttcacgatattgattcttcctatccatgagcatggaatgttcttccttcggtttgtgtcctcttttatttcattgagcagtggtttgtagttctccttgaagaggtccttcacatcccttataagatggattcctaggtattttattctctttgaagcaattgtgaatgggagttcactcatgatttggctctgtgtttgtctgttgttggtgtataggaacgcttgtgatttttgcacattgattttgtatcctgagactttgctgaagttgcttatcagcttaaggagattttgcgctgagacgatggggatttctaaatacacaatcatgtcatctgcaaacagggacaatttgacttcctcttttcctaactgaataccctttatttctttctcttgtctgactgccctggccagaacttccaacactgtgttgaataggagtggtgagagaggacatccctgtcttgtgccagttttccaagggaattcttccagtttttgcccattcagtatgatattggctgtggatttgtcataactagctcttattattttgagatacgtcccatcaatacctagtttattgagagtttttagcatgaagcgctgttgaattttgtcgaaggccttttctgcatctattgagataaacatatagtttttgtctttggttctgtttatatgatggattacgtttattgatttgcgttacgttgaaccagccttgcatcccagggatgaagccaacttcatggtggtggataagctttttgatgtgctgctggattcagtttgccagtattttactgaggatttttgcatcgacgttcatcagggatattggtctaaaattctctttttttgttgtgtctctgccaggctttggtatcaggatgatgctggccttataaaatgagtcagggaggattccctctttttctattgattagcatagtttcagaaggaatggtaccagctcctctttgtacctctggtagaattcagctgtgaatccatcttgtcctggactttttttggttggtaggctattaattattgcctcaatttcagagcatgttattggtctattcagagattcaaattcttcctggtttagtcttgggagggtgtatgtgtccaggaatttatccatttcttctagattttctagtttatttacgtagaggtatttatattattctctgatagtagtttgtatttctgtgggatcagtagtgatatcccctttatcattttttattgcatctatttgatttttctctcttttcttctttattagtcttgctagcggtctatcaattttgttgatcttttcaaaaaaccagctcctggattcattgattttttgaagggtttttcatggctctatctcctccagttctgctctgatcttagttatttcttgccttctgctagcttttgaatgtgtttgctcttgcttctctagttcttttaattgtgaggttaaggtgtcaattttagatctttcctggtttctcttgtgggcatttagtgctctaaatttccctctccacactgctttaaatgtgtcccagagattctggtatgttgtgtctttgttctcgttggtttcaaagaacatctttatttctgccttcattttgttatgtacccagtagtcattcaggagcaggttgttcagtgtttagtttccatgtagttgagcagttttgagtgagtttcttaatcctgagttctagtttgattgcactgtggtctgagagacagtttgttataatttctgttcttttacatttgctgaggagtgctttacttccaacaatgtggtcagttttggagtaagtgtgatgtggtgctgagaagaatgtatattctgttgatttgtggggagagttctgtagatgtctattacatccacttggtgcagagctgagttcaagtcctggatattcttgttaactttctgtctcattgatctgttaatgttgacagtggggtgttaaagtctcccattattattgtgtgggagtctaagtctctttgtaggtctctaaggacttgctttatgaatctgggtgctcctgtactaggtgcatatatatttaggatagttagctcttcttgttgaattgatccctttaccattacataatggccttctttgtctcttttgatctttgttggtttaaagtctgttttatcagagactaggattgcaacccctgcttttctttgttttccatttgcttggtagatcttcctccatccctttattttgagcctatgtgtgtctctgcacgtgagatgggtctcctgaatacagcacactgatgggtcatgaccctttatccaatttgctagtctgtgtcttttaattggatcatttagcccatttacatttaaggttactattgttatgtgtgaatttgatcctgtcattatgatgttagctggttattttgcgcattagttgatgcagtttcttcctagcattgatggtctttacaatttggcatgtttttgcagtggctggtactggttgttcctttccatgtttagtgcttccttcaggagctcttgtaatgcaggcctggtggtgacaaaatctctcagcatttgcttgtctataaaggattttatttctctttcacttatgaagcttagtttggctggatatgaaattctgggttgaaaattcttttctttaggaatgttgaatattggcccccactctcttctggcttgtagagtttctgctgagagatccgctgttagtctgatgggcttccctttgtgggtaactcgacctttctctctggctgcccttaacattttttccttcatttcaattttggtgaatttgaaaattatgtgtcttggagttgctcttctcaagaagtatctttgtggtgttctctgtatttcctgaatttgaatgttggcctgccttgctaggttggggaagttctcctggataatatcctgaagagtgttttccaacttggttccattctcaccatcactttcaggtacaccagtaagacgtagatttggtcttttcacatagtcccatatttctgggaggttttgttcatttcattttactcttttttctctaaacttctcttcttgcttcatttcattcatttgatcttcaatcactgataccctttcttccagttgatcgaattggctattgaagcttgtgcatgtgtcacatagttctcatgccatgtgttttcagcttcatccagtcatttaaggtcttctctatgctgtttattatagttagccatttgtctaatcttttttcaaggtttttagcttgtttgcgatgggttcaaacatcctcctttagctcagagaagtttgttattaccagtagtctgaagccttcttctgtcaactcgtcaaagtcattctccgtccagctttgttccatttctggtgaggagctgcgttcctttggagaagaaaaggtgctctgatttttagaattttcagcttttctgctatagtttctccccatctttgtggttttatctacctttggtctttgatgatggtgatgtacagatggggttttggtgtggatgtcctttctgtttgttagttttccttctgacagtcagcaccctcagctgcaggtctgatggagtttgctggaggtccactccagatcctatttgcctgtgtttcaccagtggaggcttcagaacagcaaatattgtagaacagcagatgctgctgcctgatccttcctctggaagcttcatctcagaggggcacccggctgtatgaggtgtcagtcggcccctactgggaggtgcctcccagttaggctactcaggggacaggaacccacttgaggaggcagtctgtccgttctcagatctcaaactccgtgctgggagaaacactactctcttcaaagctgtcagtcagacagagacatttaagtctgcagaagtttctgctgccttttgttcagctatgccctgtcccaagaagtggagtctaaagaggcaggcaggcctcgttgagctgcagtgggctccacgcagttcgagcttccgtgtcgctttgtttacctactcaagcctcagcaatgacgggcacccctcccccagcctccctaccaccttgcagttggatctcagactgctgtgctagcagtgagtgaggctccatgggcatgggaccctccgagccaggcgcgggatacaatctcctggtgtgctgtttgctaaaaaccattggaaaagtgcagtattagggcgggagtgtcccggttttccaggtactgtctgtaatggcttcccttggctaggaaagggaattccccgaccccttgcacttcctgggtgaggcaatgccctgccatgcttcggcgcaccctccatgggctgcacccactgtctgtcaagccccagtgaaatgaacccagtacctcagttggaaatgcagaaatcacccatcttctgcgtcactcacactgggagctatagactggagctgttcctatttggccatcttggaatctccctacccattttccataattgacatatttatagggtacagtgtaatgttttgatagaagtatacattgtgtaattatcaaatcagggtaattagcatattcttttcctcaaatatttatcatttatttgtgataagaacattcaaaatattctctcctagttattttgagttatacagtataatactgttaaccacagtcaccctatgtattagtccattttcacagtgttataaaaatactacctgagactaggtaatttataaaggaaagaagtttaattgactcaaagttctgtatggttggggaggcctcaggaaactcacaatcatggtggaaggggaagcagtcaccttcctcacaaggcagtaagaggagagagagcaaagagggaagagccctttatgaaactatcagctcttatgagaattaactcactatcatgagaacaggatgggggaaaccacccccatgatacaatcacctccctccctcaacacgtggggattacaagtttctcccatgacatgtggggatcacaattcgagatgagatttgtgtgaggacagagccaaactgtatcaccctactatgcaatagaacaccagaacttattccttctatctaactataagtttgtacctgttgaccgatctctactaatctcccctcctcatgcccccaaccctctccagcctctggtaaccactaccctactttctacttctgtgatatcaaccttttaacattccacatatgagtgagatcatttagtatttgtgtttctttgcctggctatttcacttaacataattatcctctagttttatccatgttgccacaaatgacaggatttcatttgttatggctgaatactattctattttgtgtgtgtgtgtgtgtgtgtgtgtgtgtgtgtgtgtgtgtgtgtacaccacattttttctttcttttttttttttaaagagatggagtcttgctatgttgcctaggctggccttgaactcctatcgtcccacccacagcctccagagtagctgggaatataggcacatgccactgcacctggcttatataccaccttttcctcatccattcatctgttgatggacacttaagttgattccatagcttcactattgtgaatagtgctgcaataaacctagcagtgtagatgtctatttatgtctttatttatttaactattttatttatttattctttatttaactattttaaagctgagaaattcaaaattaacttttgttctattgatatatttggccaaatttgttaagacagatacacctgtttttagaatttttcctatcccaggcttccaaagtttcaagaaaattgatataataaaccaacttattcccattataatttaaacatttccgaaattatttccattttaaaagaagttaatgtttgaccaatgaagcaattgtcaatgatggggttttattatgagtttaataatgatatttaccatttattgagcatgtaccttatgcaaggtcttcatctgtcaatcatctcttctttctgcaaatacaagacttagcaagcttggagtaagttatgaatgctaacatatgtgagatcaaatagtctctttctagggcactgaaggtctttggggacttaaaaactcgattacaatgattcagtcatataagagaaaattgcaacacacacacacacataaaacagaaaagaactatttgtacatgccaggaaacactgctctaagagttgctttattctaggtgactatgaaaggaaaaaaaaaatctaactatagagaagttaaaaaatgtacatatatttgggaagaataggaaatttcaccaaaggcctggagtcactcaaacccgagttccaatcttcttagatgtaaattaacttcattgaaccagtttactttaaaaattcttgtttttattaaaaatttcaattactattaaaattatatttttaattaaaaatactttaaaaattaaagtgtatagtttttctatttatcttaaatattcaaataattgtgaattaaagttgtgccagcttgaagatttaaagtgataggcttaataattttggaacttttcttaatgtcaaagttaactagagcttcttttctttttcaaattacacatttaaaattccggcatcagttcctttttgagtcatctaggtctctcacgtcagtaaatattgagctactgtaaagctgaagttacttacgtagtaacataacttacttaggggagatttgtaaatgtttattttggataagctatgtcttatttttgttttgcttttgagaaagatacttctcattctttgctaatttcaaacaaacagctttatagtagaaagcaattatttctataactcaagttaaataattctgtctattctttagtcaaattgaaaataagacataacaaaacaatgacccccttgccttggtttctaacttttcagaggtgaacacaaccataaatggtaactaacttacagtagtgcctactgtatccactaagcattatgtagaatacagaggtgacccagacatgcaccctgcccttaaaaaacatgaagattgaaacatattatcatgatttacaggcatagctcctcctcctccaaaaacaaaacaatacaaaacacacaaataactgtgtttgtcagaaatacagacaccaagtgttaaaatgtcagaaaatagggcagcttgaactcaacctttgcactctctagcacttgaattatattttatcaaacctttgttaagttagttcatgtattttggtgcctcagtggttctaatccaagtatagtatttttgtagatccatctgtcccagtgctgcataacagcactagaacatgtggaagagatttaacaaatagtattagctatgatatgtatatattagtatatattacatgtcaggaagtgttctgagttctttacgtgtactaattcatttagccttcccaataaccctatgcggaaagttattaccatcttctcttgacagataaagaaaccaagccacagaaagtttaggtaacttggccgaagtcatgctactaataagttatggccccaggatgtgagcacagtttgacttcacagtttgctcttataccctacactatgctacccctaaataattattcgagtcatgttaatgaggggattttaaaaacttgacagtattggaacagtatatatagtaagctgatacttccctgggttggacaactccagaagcaatctgatgtttgtttgcctgtatatttttgtttttctaggcaatgggggctaatctcactagtacttctgtagactgtctagcatatgtctttcggtgaatctttgaactcgttttccatttggtatatatctgatggtacaattgctgaattcttggtatatacataagaatagaatttctaggtcatggtataggattgctggaaactgtaccaatttgcattcccaccagcagggcataggagttccagttgccttgcatttttcccaatattttctgcctctttcattttaggtgactatgcagagacatcacattttggttttaatttgcatgactctgatgactaatggagtcaaactcattttcatatatttattggccatttgtcaataaagttttatgaggtgtcttttcaagtgatttgcccattttttaaattaggttttctgcctaattcctaattgtgtaggaattcttagcgtattctagatacaagcccttcgtcagagacataaactgaaaatctcttctcccattctgcaggatgtctgttctctcttcacggagtcttttgaggaagtgaagttcttactttacatagttcaatttaccaatttttttcctcatggctagcacttttttgtgtcctgtgtaagcaaactttgcctactccaaggtcatgaagatttcttccatgttttcttctaaatctctatcattttatttttcacatttagatctgtaatccttctggaattatttttttgcatatggtgtgagataggagttaaaatacattttcatgtggacattcaattgtccctacaccatttactgaaaataccatcctttcccccactatactgcagtgtcacctttctcataaactagttgactatatctatacctatgtctctatctatgtctatctacctacctgtatatatctgtttatggagtctgttctattacattgatcagctcatttgttttttttttttgtctagaaaattttgctaaagcagtattaatgagtttgaatcttgcctcttggggctgtgacaacacttcaggttgtgattcctcacctgcagccctatccatgccatggcaaccaccgaggcatccatcctgtggttatctatacaatgcataataaagacctcagctggcctcggcggctcacgcctgtaatcccagcactttgggaggccaaggcaggcagatcacgtgagcacaggagttcgagactagcctgagtaacacggcaaaaccccatctctccaaaaaataaaaaaattagctgagcatggtggcatgcgcctgtaatcccagccactcaggaagcagaggtgggaggatttcttgagcctgggctatcgaggttgcagtgagccgagatcgcgccactgcactccagcctcgatgacagagtgagactctgtcggaaaaaaaaaaaaaaaagataacctctatctcccactgctttcccttcccaccgtcaccccaagtttctgtcatttctttgaatttgttatttgactttccacaagtataaaagtacacttgtatcatttattttaggtattggatatcttcccttccttatgtattattttaaaagcagctaaataaaaaatttagcttggtttttgttgttgttgttgttgttttgtttttttggttttttgagacggagtctcgctccattgcccaggctggagttcagtgacatgatctcagctcactgcaacctctgcctcacaggttcaagagattctcctgcctcagccttctgagtagctgggactacaggtgcatgccaccacgcttggctaatttttttttttttgtatttttagtagagacggggtttaatgtagccttcaaataatttttttaactataaattcagtggcttttgatttttcaaaaagagtctccactcttacctaaaactacaatgggtatttgaattctagaaggaggtgattttattccaaactgataatcactataaaacattatgtcttttctactggaaatagaaatacagtgtatatagatgtttgttagacatctctaataaaaaaatgagtattgtatataactgagccttcctagaatgtttgcccacagccacagtgttatagcagttcatattatctctctcatggtcacatgttagaagtagagtcatgtagcagtatgcaagcaaatcccctgttgggatgcctgttggcttcagattagctcacttactgggcaaaacagagactatgggcaatgcccaacatttcctcatttctcataatggcttatcaaattcccagtcacaagagctaaaaccttagaacaatcttttactcttccctcttccccatggcacagctttaacatcgactgaagcttcttttatagaattgtttctccggttccttttttgtgaatttattgttactattctctctcaaacttcatataggatgttgacagtgacttaagcaataagaaagattatcacataaaacaaaacaaaacaaacaaacaacagcaacaacaacaaaaaatatatatatacacacacacaggtaggatggccctgtccctgcttctctgcgatcctctttgttctaccctactggtggatctatacccaaactggcagcaagatagcttggcagttccaggttacacctagcagaccacatctcatgtctcactggccagagtcaggtcacatacccatctttaagacagttgttggcaaggatttaccctggagccagggatgaaaccatcttcccctgagtcacatgggaaaggacacctgaacaaaattagcgtcttgtcaccatagggaatgggctctgaatgctggtggataatcaacagtgtcagctccagactctaaccacttcacttagataactgcagccacctcttaactgtggtccctgcctccagtttttggctccatcttctcaacatgtataatgaagccagtacaattctccttaaacacactgctgtcatgacagcactttcttggtcagggggcctaggtggcttcactgtgactgatggacaaaattcgaacaccttggcctccccattcaagatgtccacaaccagactccaacctatcccttatccttccttctccctagttccttacaacaggggtggtagtaaatatatcaggctttgtggaccatgtggtctctgtcacaattacagtaatattcccctcatctgtacagtagaataagttgttctgagaagaagaaggagaaagagagagagaccacattcataccacctttattacagtacgttgttataattgtcctttttttttttttttttttaactcttgtcttgctatgttgcccaagctggtcttgaactcctgggctcaagtaatccacacacctcggcctcccaaagggctggaattacaggcacgagccactgcacctggcccgaattgttctattttattagtagtaattgttgttaatctcttactgtgcctaatgtataaactttatcttttctttgcttatctgtctttccacaagtataaaagtatacttttaccatttattttatgtattggatatctctctaaacaaatcacaggtatgtatgcataggaaaaaacacagtatgtgtagggtttggtactatgcacagtttcaggcattcacttggggatcttggaacataacccctgcagataaggaggggactactgtagtcaattcttcccttgtagtgcaaaagcagccatgcacaatacaatacaaatgaatgtgactgtattccaataaaactttatttacgaaacaggcagtaaactaaatttggcccacaggacacactttaacaatccctgccttacatgaaatcccttactccactaggccctaagttggtaaaatcaacactccattggagccacaaagatgacaacataatggtatggggaagtcctacctacacaggacatctggcagggtccgggcttcatgtctgacatatcgtcaagagttacattggcaatgagactagttttcgtaaatttattcagtttgatcattcagctgattcaaagatcaaaagatcctttagggctgtgttttctgacctttttaaggctgtggtacatggatttgttaggctaactgagacaaataaatgagtttgtctcttcactatgctgataataccttggcaagtcatcagtcaagctctttttctcacccttacccccagatctacaccctgctcctacaatcttatctctgtctccttctcccttctaaaagaaacctgatgaaacaaaaagaagaaacccagagataataatacacccaagatcatactgatagacctacatgtgccaaacattggttgagaaataatgtcttgtgatccacaataatcagtaccaaaaatccaagtacttcacgcggtcttaggaaacaaatatgtgggaaaggctgaggcttggcttatttagttagcttttgttttagaactacataaacagagagtgtaaatagtaacctgattaaaaatacggactttagggttagtttatctgggtttgaattctggttctgctgcttcctgtttatctgacctttggtaagtgacttaacttctttgtgtctctatttcttcatctacgtatctgacccagagagttgttaggataattatgtgaattaatatgtgcaaaaatttaaaaatagggcctatcacattgttaacagcatatatgagttggtaaaaggatatatatatatgttgcgtcttaggcatggagtaaaattcatgtaaacaaaaaaacagagtgaatattcacttaggcaggcagtctgctccatgtaatcattcaaggattcagatagacaacggctctgccatcttcaacatgtggtcttcaaattttccctggaggtctccatacagttaaatagactagaagggcatacagaatctcagtgggagatttttatgcgctagatttaggaatgatgcgcataatttcctttcacattccattagttagaatttagtcacatgaccataacctaatcccaagggagactggaaaatgtagggtagcttcccaggaggaagaggagtatatagatttgatggaagacctatcagaattggttataactgagtatctggacaacaccatattggtactggtatcctagcaagaaaagtgtacattgaattgtagtatctatagtgccattagcctttcatgaagttattttaataaaacaacttttttgaaactagttattaaatacggtctaaaaataatgatgaggaactctttatttcattacctagtgtgctttctaaagaacactaggaaaaatttccctttgaccttaatacaaacacacaaacacaaaatagttgtgtttccccgagtgaaaagttgcttagctttgcccctgctccccaaatcttggaaatattattaattgtttaactgtccaagcttggcttagaaagcttagaatcaattttattctttcactcaactaatttactgagcatttactacatgtcaaacttcaagctagacactgaggattcaagagggaacaagacagacatggttcttgccctcatggaattcacattctaataaggggtcaaggaagtggatgtgtggaaacatataacgaataaacaaatgactatataaatgcagcaataccaatcaataagggaccaagctaaataattgccaaattgggaaccaattttaaatgggatggctgggacaggggcttcttcaaaaaggttgaatttaaaccgagccagccatacaaaagggcgtacccccagcaggaggcacaatgtgcacaggagctttgatgagagattgagttaaggagttcaagggctagaaaggaggccagggtgactagagagtggagagcagagcagggaggggcacaagatgagactgtgcatcacgcaggcccgtgacagccatggtgaagagtccaaattctgttctaaatgcggtgggaagtggttgcaagtttttgtttgtttgtttttgtttttgttttgagacagagtctcgctctgtcaccaggctggagtgtagtggtgcaatctcggctcactgcaacatctgcccctcgagttcaagcgattctcctgcctcagcctcccaagtggctggcactccaggtgcactccaccacgcccagctaatttttgtatttttagtagagatggggtttcaccatgctggccaggatggtttcgatctcttgaccttgtgatccacccgcctcggcctcccaaagtgctgggattacaggcgtgagccaccgtgcccggtcagttgcaagttttaagtagggggaaatgattgatccagcttgtgttatgagatcatttgggctgcagtgtggaggaagaactaaaaggacatggaagcaggaggacagccaggtgatgggtgtcgtaagcctgggaaatgtgatggtaatacaagcatgtcaagcccgcagatcctgacagtaagcatgccttcctgacttgtgcccggggagaggaggcgacagtgattctgacctcttcttatttccctccctttctagcgccactttcctgagcttttttactgtatgttatgtataccgtatgctgtatgctgtatgctgtatgctgtatctaacagcccttgtaaacagccttaaatcctttctaaacatcctggatagtcctagaatcctagaatatggattctttcttggtttcaaaactgatttcattatattgcatggaaagaagaaatgtctttattgtagagtgttggtatttctgggtaggttgattcaaagattaagttgtgagggcagttgggacttttagagaaagtggatctagaaaatctaaattgttactaagaaatattgatgaatgtaggtcatggagctcagaaagaagtatctctttgatatttttcctaaactatgtgaaagggaagcaatgggaaatttcgtgaacggagtcaggaaagcctcaagttgggtggctaggaagggtagaggagttgctattagggaaccgaggagtgaatgtggagatggtgaagtgagacaggaggctgcttcctcaaaagtcaggacagttatgagaatgctctggtttgaatgtcaagatgttactggaaatgaataactacaaatacacgcatgttcatgcacacacacatacacaaacacatgaagctattgaaaagaatatgcagcaaatgtgttttgtaagtgagctagtatctagttgaagtaccatgatcatctttaaaatctcttgctagaagaggaatgttgactgcccagtgtgggtgtggatagggaatgaatatcctcgctgtggtatccataattgaaatgcactgtgcctcatctccagaccagcccttacagcagtgccaatctccttcttgtccactgcacaatagctcgctgactctgcctactctttggtcagtttcccggatatccttgtctcttcattcttagtacatcacatcattactcaggcctcttgcctgggcccctggcagctttaggtacctcattcagcgcaactgttttcctgttttcttgagcagtgaggtcataatttcatgaccttggatacacattgcgtgaagtaaaatgtttattaagtcagatgaattaataacattttcaggaagttcataattgatggagacaaattacatatgtaccatacatcaacacacacacacacagaatgtgcacactcaggagagattaatagtgtgtatgtttattagatataaagcagctgtagcctatgaagaaaggacagaagaaacagcgaggtacaggaactagagtcgacaaagaagaaaagcaaagatgcccacatacatcctacttttaatgcaaagcttgtctctgctggataacatcacaaatcccccaactaaaatcaccaattgttctgtccctaaagatatctttctagttctcaatcccaggccaggtggggctctatttaactctcttttatttaatccacttttgatcactcttaggaagtttcactttactcaacaagctcaagattgatcacccttgactttatctgtttatcttaggagtgtttggttgaagacagaaccacagatgcccattattactagtattatcataacaataaagaggagcaatagtaaataaaggaaacccagagccagattatcgggacttaaatctgttttcccacttttgtgatgtttgaccttcagcaaattatctaccttctctatgcctccgtttccctattcataaaatggaaacaatgaaagtacctacctcgtagggtttttgtgagagttaaatgggttcatacacataaagtacttggatctgccctggcaatatttagacctctgtgaatagtaacctgtattactgcgtttcagttaggaatgactaaatgttgcggcaaactgcacattctgttgacccttcctggtcactgctcacccatccgaagcctgtgtaatacaatattcaactctgaaactgcatctaaggtggccaggaaggaaagctggagggaaatgtgtagaccagctgacctctattttaggttgaaggtccaggcatttcctcccctttctctacctgtgagaggagccaaccagagctggccaagccatgatgcagcccctcgtgtggccatttccttcccagcctctattcatcttttaccactctctagcagcagaagctggtgggttgtggttaccactcttgtttgttgccccacatcccagcttcattttctcaggatcactgccaggcaataaggaaagtttggggcctgaaaaaatctgccccaggcctgtgtagagcaaaatacccttggacattatacccgcagaaggttcctcaaaattatgtgacatttttcagctgatcgaacttccctaacctgacttcctggaaaagccaagaattcagagaaaatgtagggcactgacgaaccaatgaagaggtcagtaaattctcccggagtccccactcaggtctgaaaaatgttgtgtgaaacctgtgggtagggatagcctccaaatatttgccctcccacaactgtccataggcctagttgccctgccatagctaggtcccaaattgttgcaaaagccataaagccatatccatgtagattctgccaaaccagctaactggccaatctgttttcccacaacatgagttaccttactgggatgtgcgtcttcaggtatatgcacttggatccagttacagcaagttaccccaaggaaataatcagacaagggcatagagctgattgtgaagggtcattcatggtgcccatggttttgtaatatcaacacttacaaattagaagcaacctaaattgccatcactaggggatggcttaaacaaactatggcatacccatacaataaaatatttatcagtctttataaataatcatggggtctgtaattaccaacatggaaaaatgcccatgatacccttgaaaagtgataaaacagttcacggaattacattctgatataatggtacttattaaaattgcattctccagcctgggcgacagagcgagactccgtctcaaaaaaaaaaaaaaaaattgcattcatcaatgagaacacttggacacaggaagggggacatcacacactggggcctgtcgtggggtggggggaggggggaggggtagcattaggagatatacctaatgtaaatgacgagttaatgggtgcagcacacctacatggcacatgtatacatacgtaacaaacctgcacgttgtgcacatgcaccctggaacttaaagtataataataataattaattaattaattaaattgcattcatatgaatggtacctattaaaattgcattgatatgcaattttaataagtaccattatatcagaatgtgtccagggatctacagaaaattatgttcacaaaaatactgacagcaattatctctgtggttgagtatttgggtaatatttactgttattttttacttttttttggtatttagaaaacacttagcaatgatacaatgtgctatctgaaaaaaactaaactttttaaaatataagtttgaggggaaaatgaactaagttagtaatgttttgggaataagatcatgggttggccacaccaagcaggtaatggcacaaggataagataattaacatttattaagcacttattacatgccagcaggccctgttctaagcactttccgtgtatcaactcatttcatttgcacaactccacaaagcaagtcttttatggtgcccattttacagataatgaaatgaaacaggcaccaagagaggaagccgtttgtttgaagtcttacggctggcaggaggtgaaacagagatttagacagaggtctgcttccaaaatctctgagcgtgacccctgtgctcccctgcatagggctggctttcctgcaggggaggagggaaggtgctgaggtcagaggaggagagaggaatgatggagggagtggagagggcagaggtggctgctgacgatggggaacaagacactgtcctcttccccctgcagttcctgaaggatcttcattctcccactggccacctgtttacctaacccctctaaagcctcagtttcctcttttgtaaagtgagggagccttctcaggccattcaccttaattagttcctctctatgccatataaagtcctagaagccagttctgctgtggcacatatgcagccaccaccatcatcaccagcatcccacttccggctgagagacgcaggccccggtgtctcccagtgtgcaagttgtcagagcaggctggaagagaattgggcattctctgtctctgctgtagaatgaccaccctgaaggataattctgctcacttgttattctcctcactggacaggagaccctggaagcagagacaatatctgatgcacctctgcattcccactacctggaacataaagtcgttcaataaataaacatcctctgttgaatgaataactggaaagtacagccatgtggccttatgattccagagtaacaagtaggaaaagcaacacttgcatattaatttctttattttttgtttctgttttctaccttatctggcacagagttcagagtaggtacagtcattaaagaagtcactgatttttaacatgccacttaagcaaaaggagcaagaaggccctatttatgttgatcaactaattcaagaaattctgggcttttgttttttcttttcttttttctttttctttttctttttttttttttttttttttgagacagggtttcactcctgttgcccaggctggagtgcaatggtgcgatcttggctcactgcagcctaccaggctcaagaaattctcctgcctcagcctgccgagtagctggggctacaggcacatgccactgcacccagctaatttttgtattttttgtagagatagggtttcaccatgctgcccaggctggtcttgaattcctgagctcaaatgatctacccaccttggccatccaaagtgctgggattacaggtgtgagccaccacacccagccaaattctaggctttctatgtaaattataaaatgtaatttacaaaactctgttcagacattttatcaccaaggcagagagtggtcaaatcacagagctagtaaggagtagaaccaaatccagcttctctgcccttggtgtcaactgctttttctactttccacatagctccacccctccagccagtcacaatggtttctaaaagtggacctgcctttgcagttattcattcaacagaggatgtttatttattgagcaactttatgtttcaggtagtgggaatgcagaggtgcaccagatattgtctctgcttccagggtctcctgtccagtgaggagaacaacaagtgagcagaattatccctcaaggtggtctttctaagcagagacctgccttaattctgttgccttaggtgagatcaacttacttctgcatgcttccatttctcctcccccttggtagattgagaatcatggtatcagctcttcttagtgaaagaaaatctaagaaacatagacaggtgtccacatcttgaagtagctgaagtttgtctttgggttctcagcttccttttctccctcttgcttacttcccttcaaggattgctgccatcagtgtcatcaaacccagggattccctaatgctaatccaccaattagagcacggctggttactacagaaccactgatgagtttcaaaaaatgcagacttctggaccccacccttggagattttgaatcaggaggtcttaggtagtgcccaggcacctctatgtttcaggttccccaggggattctaacctgcagccatattggggaaccactgacctaacacgaaaacatgagtcagctgtctcaactgtattgaaagtgatgaatcatcatttcactttaaaaagaaaaaaatatgagctgaaaccaaagtcattgtgagaacctttcatttcctttacctgagtttgaattcaggtttcctttacttgagtttgagtttagaagtcttctatacttggtccaagcatttttacggagattcccaaggtcttaaggcaaacagacttaagacctgtcctcagtttagtcctgggaacatgctgtaaccctgatcagccctggctagggggaccctgggaaactggctggctctggagatccttcaggccagagttgctgggaaccacaccgggttcatcttacaccatgcctaggtgctggggtccaatagtcttgtctcctctggcttcccagagccagaactaggaagacgagaaggctttgggatatggctggcttccagagactgaatcagcaactcatattctcaagaccgaggtgggtaggcctgacacagaagggtcaggaggctgctagaatctatgacagggcaggaacagcgctgaggcagcagaaactgagaaagcagaagtcaccagaaagagaaaagaagttcaaagtagagggaaagactgaggaaataagcagggtgagtcgaacagatgagatgtgcagagagaagcagatatgagctgagggagagagactcaatgaaccacgagaggtgggcaaagaaagcagccagtcctgaggttaccttgtttctgacagtttgggtcctgcccatcctttcttttttttttttttttttaagtgattgattgttggttgtttttttttattattattatactttaagctctagggtacatgtgcacaacgtgcaggtttgttacatatgtatacatgtgccatattggtgtgctgcacccattaactcatcattaaacattaggtatatctcctcatgctatccctcccccctgtccccaccccacaacaggccccagtgtgtgatgttccccttcatgtgtccatgtgttctcattgttcagttcccacctatgagcgagaacatgcagtgtttggttttttgtccttgcaatagtttgctgagaattatggtttccagcttcatccatgtccctacaaaggacatgcactcatccttttttatggctgcatagtagtccatggtgtatatgtgccacattttcttaatctagtctatcattgttggacatttgggttggttccaagtctttgctattgtaaatagtgccatgataaacgtacgtgtgcatgtgtctttatagtagcaagatttataatcctttgggtatatacccagtaatgggatggctgggtcaaatggtatttctagttctagatccttaaggaataaccacactgccttccacaatgcttgaactagtttacagtcccaacaaaagtgtaaaagtgttcctatttctccacatcctctccagcacctgttgtttcctgactttttaatgatcgccattctaactggtgtgagatgatatctcattatggttttgatttgaatttctctgatggccagtgatgatgagcattttttcatgtgtcttttggctgcataaatgtcttcttttaagaagtgtctgttcatatccttcacccactttttgatggggttgtttttttcttgtaaatttgtttgagttcattgtagattctggatattagccatttgtcagatgggtagattgcaaaaatgttctcccattctgtagcttgcctgttcactctgatggtagtttcttttgctgtgcagaagctctttagttttattagatcccatttgtcaattttggcttctgttgccattgcgtttggtgttttagacatgaagtccttgcccatgcctatgtcctgaatggtattgcctaggttttcttctagggtttttatggttttaggtctaacatttaagtctttcatccatcttgaattaatttttgtaaaaggtgtaaggaagggatccagtttcagccttctacatatggctagccagttttcccagcaccatttattaaatagggaatcctttccccatttcttgttcttgtcaggtttgtcaaagatcagatagttgtagataggctgcattatttctgagggctgcccatccttatatcaccaattcaattgaggagactcgaccaaatgttttatttttctaataactgttgccagtagtattctgggaaatccttctagcctgttgggcagtgagtgaccctcatcatatatcagtgcaatttcatgatttgtagatcacttattatgactcagtctagtcccatgttttctaatagcttttgagatctaattcatataccatgcaattcactcatttagagcaggggttcccaaaccctggactgtgaaccagtacccatccatggcctgttaggaactgggctgcacagcaggaggtgagcacccagcaaatgagcattaccacctgagctctacctcctgtcagatcagtggcagcattagattctcatagcagtgcaaatcctgttgtaaactgagcatgcaatggatctacgttgcttttcttatgagaatctaactaatgcctgatgatgtgaggtggaacagtttcatcccaaaaccatttccaccacccttcccacaatgcacggaaaaattgtctacgacgaaactggtccctggtgccaaaaaggttggggattgctgatttagagcatacctttcagtggtttttagtatatgcacagagttctgcaaccaacaatataattaattttgaaatattttcatcatcccaaaatgaaatcccatccctctagcagtcaccccctagttcccctcattcctcccagtcttaagtaattatttcctgtctctatggatttgcctattctggacatttcgtctaaatggaatcatacaatatatacaatcttttgtgacaggcttctttcacatagcataatgttttcaaggttcacacacactgtatcacgtatcaggactgcattcatttctaaagctgagatatattccattgtatggacatactgttttttattgtctcattcatcagtctctggacatctggtttgtttccaattttttgatactaagaataatgcttctatgaacattcatgcagacatttttgtgtgtacatttcatttcttttgaaatatacctaggagtagaacactgggtcgctatgtttaacattttgaggaagtgacagagttcatctcatttaaaattccaatcccatattttacaaatatgagatattttacaaatatctctcctcccagaataggtgaaacttatgaccctgcaatcttcaagttgggcagagaaatggctcaggtctcaggcggttgcagtctaagggtagtggcctgtgataatggctggggcctcccatgcctttggcttccttctcttctgcatcacacgaagccatagtaactgttggggtttttggtcatccttgaggactcaggagcctgggatgtgaatgatatccccattttcttcattcctgaaaataagtctacagcccttttcactccccgggtgtgggacacccagtgaacctcccattttcagaaacttcaggcaagaagcaggtattaatctctatacaaggcactctcaaactttggagatatgcgtttagcaccccttttctctccccaagaatgagaggagactcagataatatacatccactctaggctctcggaaccttctccctgtctcttagtctccttcttacttgtctttgttcaaggccagtgggccagtttaatttctctcctcctcctctcttctctcctctcatttcctgcccccaaccctgcacttgaaagactcattgaaggaattaggcctgactttattttttttaccatattaacaaaacgatatttctttttgaaaaatttatttttattatttttaaagacagagtcttgctctgtcaccctggctggagtgcagtggtggaatcatagttcactgcaacctcaaactcctggactaaaatgatcctccctcctcagcctttcaagtagctgggactataggtgtgtgccaccactcctggctttttaattatttttttaattgacacataaataattatatagatttatggagtagagtgtgctatttcgacacatgtctaagatgtattataattaaatcatagtaattagcatatccatcatctgaaacttttatttctttgtgttggaaacactcaaaatcctctcttctagctatttgaaaatatagaatacattgttgttaactgtagtcaccctacagtgctatagaggccttacttaaatttgacctttgtgagttcagtaacttttcctcaacaagaagccatctacccagttatttcttcactattcagtaacatggggcagaaaaaaatacttaatcagtgccccacatcaatctgttacacttataataaatctctttttattttgaaaagttcttttctgtgaatgagccaaacctagacctctctccttctaagaacaaacaagtatttcagttgctccggccagaacttcaattcacacctttccttctcttactttgagaccaggcctttcttagcacatagagaccaggtgggactgcaagccaagtgtggactttgaggatgatgaccagtgactcacctccagcccctggctgaccatgacacaagggaggccaattttcgggctggcccccatgtggtctccctcctcctcctctcttcccccagctgctcatgacctgcctgccccaccccagaaattccttgtccccattttctttttcatttgagacagagtcttgctctgttgcccaggctggagtgcagtggcacgatctcagctcactgcaacctccgcctcctgggttcaagcaattctcctgcctcagcctcccaagtagctgggattacaggtacctgccaccatgcctggctaagttttgtattttttagtagggatggggtttcatcatgttggccaggctgatctcgaactcctgacctcaggtgatctgcctgcctcggcctcccaaattgctgggatttcaggcgtgagccaccgtgcccggccccctctccccattttcaagagattaagctggtcttcacctgcttccttcacattccagataaactcacagcagatccctgcttcctgactttggaaacgttgctaaagcaggttctagataaactgctgcctcctcatttctcacaccttccttagctcttgctctttgcctgttttcccaaaattcaagtgcatttctttctcatcctcaagctgtatttttttcccttataaaaccaagcagagtgggaaatactggacttatttttttggacctgaaagcattaacattgatttagcacctgctgtatgacaagcactgttctaggtgatttacatgaatatttacatcatgtcatattacaatatattacattacatcgcatcacatcacatacattgtattgcatcatattatattacattgaactacatttgcattacactgcatttggaggaaaatatcttgggaggaaaggacagaaatggttgtagcatttcttacctactctgccctacattcacagggtgatcttggttaagctctgtaatctctctttgtattaactttcccttctataagataggaggggcctcatagattggctggtgacataattattaaactcattatattcttattatagtctaatagtttatgaccaaaattctaattttctatttccaagtgacaatgcaatgttgaagggggtgcctaattctacacacagacacacacacacaatttagctatgcctctcaggaatcttctattaaaaagagaacaaagctaaattaaataaattgccagccaggcatggtggctgacacccgtaatcccaacaatttgggaggctgaggtggatggatcacttgagctcaggagtacaagactgttaggttttgaagggaaggcgagacttaaagaaagacacacacacataagagggaagttcaacaacaaatgcagactttatatccagcataaaacctacagaagtcagagaccagtctaatgccagtacctgctgctgcttataggctggggcaatttataggtatgggcaggaggggtctgggcagtatggcttgctgcctggcaggaaattgataagatggtcccatgatgaggcagttctggtccttgttcaggcaggatgtcatcatggtgttccttggacctttgcccagaaggtctttgccttctagtttagcataaaaaggaagaggggcattgttaattatctggctgtttcctgctaaataggagcactgcactcaggctttgggttttcagcagtgggtgtccgactttagagttgttttcctggaagtgctgataccaaacttggcagagaagaatggtatcgtgtttctatatagctgcctggacaagggagttcggcctttgggagataaagcgggatatgaaggtgcgcacacatgggccaattgtcagtattatgagggagaaaattagggaccctaagacaggggttacccaaggtatccactttaggaaggatgacccctgccaacagtgaatgacttgatgttggatttctgcagccgtgtaatggagcctgtgggctgcgttgcgaacaatgccggcttcattaacataaaaacagcattcttcttggacatatacacatgtgccccaagacaagaatgttaatccaaactgcaccattttgtaagcgccctgctattttgcagaccttggtaaaagtgacacatttcatgggtttttgggccatgagaaacaccctgcctaaccacttgaccacaaggcccacaaaggcccaactaaagaaatatctctatcatatccttctgggcaaaggtccaaggaacaccacgatgacatcccgcctgaacaaggaccagaactgcctcatgacgggaacatcttatcaatatcctaccgggcagcaagccatactgcccagacccctcccgcccatacctataaattaccccagcctgtaagcagcggtaggcactggcgttaggctggtccccgacttctacagtgtgcatatttctttaaccctcgccttcccttcaaaacctaacagggatcagcctgggcaatatggcaaaatgccatctctgcaaaaaaatacgaaaattagctgggtgtggtggcgcatggctgtggttccagctacttgagaggctgaagtggtaggatcgcttgagccccgcaggttgaagttgcaggcagccctgattatgccactgcactccagcctgagtgacagagtcagaccctgtctcaaataaataaataaataaaaataaattagaaacacatacagccctttgttgatttctttaaatgttttcttcttgttatttttcagtaatctaactatactctccattattgcttttaaaaaattatttctgtctttacaaaagtaatttgtgctcatggcagactatttaaaaaacaaaatgaagccaaagaaagaaaataaaaattaactgcaggagaaggaggcaagagagctaactagatgcagccaggagaaacacctctcacagagatcttcccagattttcagagggaaggcatcaagagtggacagagggaagacacagaggctgggctgaagcaggaggaagctgaaaaccctgcatgaggctaccacacactgggacttgttcctggcccccaacaactcctgcagaagggatgagttgaacaggcaaggagaaacatgctcttgcaatgggtctctggaatcacgacaggaagagacccctcaaccactgtggacacttgagttggcaaggagagctgcttagagaagtggtaggggcagagctccaggtgatgtggagcccagtaggtttcgtgcgggagtgtttgtggtggagtacagccagcgatgtccatctccctaggctcaacttgcttccataggagactttagcaccaggggagctgtcggtcctaaattctgcagggcggtgttgcccatgagatagggccagtctgacttcagcaccctttggtctgctagcctttcccagggccccagcctgtccatgcctgcttgcagtgcagccaccaggtacctcctgggagcccacatcatagcacctgtgctggcagaccatgccagactgtcagagtgctgcagcagagtagcccccatggacacacaccagcccacccagctcatcccctaactacagcctcccccttgttgctttgcttgcacacacttgcccacagccacccttcatatcactttgccagtacctgcgtgtacaggcagacctcaccttcccttccccaccagcatacgtgtgagcgtgtgccctgccatgccactgctgctggtgtgagtatatcctgcccctcctttccctgcagcactgtccactgtgatggcaatggcattgtcatcagagtgttgttgggcatggagctgccagctccgccccagccagtccccagccctgcccctatgcgaacactgcctatggcacaaaactaggcacaaaaaccagcaggcccacccctgccctgagcggccaatgcctcccatgtgaatgtgcacagggggcacacacagccctgcatctagcagcatcctgctcccatgctaatcccaacactggcacaaacatgtgtacagttgctggtgagggccccccaacctgcctgagccatgctgccactgctgcttctatgaacacctgcacgaaggctggcactccggcatccactagcaccttgctgcagccaacaagtgtgcaccccactgcaccgctgctgccactgcgactggcacatgcgactgaggatggatcatgtttccacagccctacaaagcactttggctggcaccatgcctcagagagttgtgatcagaggtccaggagcacctcaggcccctccaacatagcaggttcctaaccttaaggagccagagaacaagaccggggcctgataccagtgccccagagttataacacacagtttgggagtcctgagctgagacttgggcccctaaaatcttccagaaatgaagccagtctactgaacccaccttataccacaatcaaaccccgaaggtcattaaatatgatataaaaagggggaaaaaaaaacaaaaacagcaacatcaaagattgaaggaacatcattctacaaagatgagaaagaaccaagataagaactctaacaactaaaaagccagatggtcttctttcctccaaacaatcacactagttctccaataatggttcttaaccaggctgagatagctgaaatgacagaagtagaattcagaatattgataagaacaaagatcatcgcaattcaggagaacactgaaacccaatttaaggaagctaagaatcacaataaaacaatacaggaggtgacagacaaaatagccagtatagaaaagaatgtaactaaactgatagagctgaaaaatatactacaagaatttcataatgcaattgcaagtattaatagcagaatagaacaagctgaggaaagaatctcagagcttgaagactgactttctgaattaagacagacaaggagacagtcagacaagaacagagaaaaaagaataaaaaggaacaaacaaaacctttaagaaaaatgagattatgtaaacagaccaaatctatgacttattggtgtccttgaaagagatggggagaatgggagcaacctggaaaacatattccagcatatcattcatgagaacttcccaacctagctagagaggccaacattcaaattcaggaaatgcagagaacccccacaagatacttcacaagactgtccccaagacacataattatcagattctccaagatggaaatgaaagaaaaaaatgctaaaggcagctacatagaaaggaaaggccatctacaaagggaagcccatcagactaatagtagacctctcagcagaaatcctacgagccagaagagattggaggcctatattcaacattattaaagaaaagaaattccaaccaagaatttcatatccagccaaactaagattcataagtgaagaaataagatatttttcagacaactcaacgctgaggtaatacattaccaccaggcctgcctaacaagagttcctgaaagaagcactaaatataataaggaaagacagttaccagcctctacaaaaatgcagttaagtatatagaccagtgacagtataaagaaaccacacaaacaatgcacagaatggcaagctggataaagaagcaagacccaatggcatactgtcttcaagggactcatatcacatgcagtaacacacataggctcaaaataaagggatgggaaaaaatttaccaagaaaatagaaaacagaaaaaagcaggggttgcaatcctaatttcagacaaaacagactttaaaccaacaaagaccaaaaaagaagaagaagggcattacataatgataaagagttcaacaagaagatataactatcctaaatatatatgcacccaacacaggagcactcagattcataaagcaagttcttagagaccttcaaagagactcagactcccatacaacaatagggggagacttcaacaccccactgacaatattagacagatcatcaagtcagaaaattaaaaaagatattcaggacctgaacttaacactggaccaaatggacctcatagacgtctacagaactctccacccaaaaacaacagaatatacattcttctcactgcctgccacatggcacatactcccaaatcaacgacaccatcagacataaaacaatcatcagcaaatgcaaaagaccaaaatcataccaaccactctgtagaaccacagtgaaataaaaatagaaatcaagactaaaaaaaaaattgctcagaaccattcaattacatggaaattaaacaatctgctcctgcatgacatttgggtaaataatgaaataaaggcagaaatcattaagtttttttaaaccaatgaaaacaaagacacaacataccagaatctccaggacacagctaaggcagcgttacaagggaaatttatagcactaggtgcccacatcaaaaagttagaaaggtctcaaattaacaacctaacaccacaacaaaaagaactagagaagtaagagcaaaccaaccccaaagctagcagaagacgagaaataaccaaaatcagagctgaaatgcaggagaatgagacatgaaaaaccattcacaagatcaatgaatccaggagctggttttctgaaaaaataaataagatagatagactgctagctagactaataaagaagaaaagagagaaaatccaaataaacacaatcagaaacaacaaagggaatattaccactcaccccgtagaaatacaaataaccatcggagactactatgaacacctctatgcacacaaactagaaaatctagaagaaatttataaatgcttggacacatacacccccaagactaaaccaggaagaaactgaatccctgcacagatgaataatgagctccattactgaatcagtaataaatagcctaccaacccccacccccaaaaaaatgcccaggacctgatggattcacagtcaaattctaccagatgtacaaagaagagctgacaccattcctagataaattattccaaaaaaattgaggagaaggggctcctccccaggtcattctatgaggccagcataatcctgatactaaaacctggaagagacacaataacatcaacaaaaaacttcaggccaatatccttgatggacattgatgcaagaatccttaacaaaatactaacacactgaatgcagcagcacatcaaaaagcaaatccaccatgatctagtaggctttatacccaggaggcaaggttggttcaacatactcaaatcaataaatgtgattaattacatagacaggactaaagacaaaaaccacatgattatctcaatagatgtagaaaggttttttataaaattcaacatttctttatgttaaaaatgctcaacaaactaggtattgaaagaacatgcctcaaaataagagccaactatgacgaactcacagccaacatcatactgaataggcaaaggctggaagcattccccttgaaaaccagcacaagacaaaaatgccctctctcaccactcctattcaacatagtattggaagtcctggccagagcactcaggcaagagaaagaaagaaaaggcatccaaataggaagaagggaagttaaacaatccctgtttgcagatgacatgattctatatctagaaaacccctagtctcagcccaaatgctccttaagctgataaacaacttcagcaaagtttcaggatacaaaataaatgtacaaaaatcactagcattcctatacaccagcaacagcgaagccgagagccaaatcaggaacacaattgcacttgcaatttccacaaaaaaaaaaaaaatacctacgaatacagctaaacagggaggtgaaagagctctacaatgagaattacaaaatactgctagaagaaattagagattacacaaacaaatgggaaaacattccatgctcatggataggaagaatcaatatcattaaaacgaccaaagcggtttatagattcaatgctgtttccaccaaactaccagtgatattcttcactgaactagaaaaaaatattttaaaatttatatggaaccaacaaagagcccaaatagccaaggcaatcaaagcaaaaagaacaaagccagaggcatcatcctaccagacttcaaactatactacaagggtacagtaaccaaaacaccatggttctggtacaaaaacagacacatagaccaatggaacagaatagagaacccagaaataaggctgcacacctacaattatctgatctttgacaaagctgacaaaaacaagcaatggagaaaggacttcctactcaataaatggggctgggataactggctagccatatacagaagatggaaactagactccttccttacaccagatacagaaatcaacttaagatggattaacaacttaaatgtaaaacctaaaactataaaaaaccctggaagacaatataggcaataccattctggacatagaagtgagtgaagatttcatgacaaagacaccaaaagcaattgcaacaaaagcaaaaattgacaaatgggatctaattaaactaaagagcttctacacagcaacagaaactatcaacaaagtaaacacacaacctacagaatgggagaaaagttttgcaaactatgcatctgacaaaggtctaatatccagtatctataaggaacttaaacaaatttacaagaagaaaacaaacaacccaattaaaaagtgggcaaaggacatgaacaggcgtttttcaaaagaagacatacacatggccaacaagcatataaaaaagctcaatattacttatcattaaagaaatgcaaatccaaatcacaatgagagatcctctcacaccagtcagaatggctattattaaaaagttaataagttggccgggtgcggtggctcacacctgtaatcccagcactttggaaggctgaggcaggtagatcacaaggtcaggagatccagaccatccaggctaacatggtgaaaccccgtctctgctaaaaatacaaaaaaattagccgggcgtggtggcgggcgcctgtagtcccagctactcaggaggctgaggcaggagaatggcatgaacccaggaggtggagcttgcagtgagctgagatctcaccactgtactccagcctggaagacagagtgagactccatctcaaaaaaaaaaagttaataaacaacatgctgacaaggttatggagaaaagggaatgcttatacactattggtggagtgtaaattagttcaaccattatggaaagcagtgtggcaattcctcaaagagctaaaaacagaactaccattcaatccagcaatcccattactgggtatatacccaaagaaatgtaaatcattctatcacaaagacacatgcacacacatgttcatcatagcactattcacaatagcaaagacatggaatcaacctaaatgcccatcaacgacagactggataaagaaaatgtggtacatatacaccaaggaatactatagagccgtaaaaaagagcatgtcctttgcgggaacatggatggagctggaagtcattatgcttagcaaattaatgcaggaacagaaaaccaaataccacatgtgttcacatataagtgggagctaagtgataagaacacatggacacaaagaggggaacaacacaaactggagcctagctgagggtggaggccccagggaggagggagatgagcaaaaaaaaaaaaaaaaaaaaaaaaaaaaaaaaaaaaaatgactgggttctaggcttagtatctaggggacaaaataatctgtatgacaaacctccatgacacgagtttacctatgtaaaataaaagtttaacaaaaaactaaaaaagttacctatgtaaaacaaaagtttaacaaaaaactaaaaaaagttacctccacccagaaatgcctttattaacactttggtttgtaaccctccattattttctctagacatatagatttatgaggcaggctaatgtgctgagacactagcttgagtttcatttggccttgctgtgaatatacctgggccttcctttgcttcaggatgccctaaactgtggcaaagcagagctgaactgcccaaaggaaagtgtgaagaggagaggcaggccaagcctggagaaaggctacccaagagagaggaaaggaaactgtggtgagtgcacctcactcctaaagaaggacaggaactctggtaggtgaggtgtgttttccatagatactaaaactcaaagccacacaggggacatatgtccattcctcagccagtcactgtggccaggaacagagggtcaggtaagagaatggcaactcctaaggaaaccacatgcctggagccgtgggtgtagaagcagatccccagaggaagcacgggtcccacagacacagtcccaactcttgccgtctaggcagccactcccatctgtaggtactacacagcttcgtagtacttcttaaagtacttcttgttcaagcgatgggacgaaaagaggatgcaggacaaggaggaggaaaggagatccttgcttttgtagaagaaacaaggaggcagggaaggcttagaggacaggcaaggagagatgttttcttaaaaacatcctctgtctgagtgttcagccccacatctctgctggtcctacccctataagcacaaggaaaagggcgggaggcagcaggagaaggattgatcattcaggcctatattcaagtttgccttttcttgccatgtggttttaatctcaccaatcacaagcctgaaggtatagtggggccactgaggtccgagttcaaattcagccatgcaactaaggaaacattgtttgatcttggtcctgttttctcatgtgtaaaatgggtctaactctaaaccacacattgcactgagaatgaaatgaggcactatgaaatgaagtgaggttagttgaataatgttccccccaaattcatgtctactgaggacctcagaatgtgactatatttggaagtagggtctacgcagatgtagtctaaatgaggtcatactgcattagggtgggcactaatcaaacggatggtatcctcataagaggagaggaatgtagagatacacacagaaaagaatgtcatttgaagatggaggcagagattggagtgatacaactataagtcagggaatgccaaggacttgaggtcatgtgttacagaagccctaggaaatgagtcaatttcctggcacagcactaagacatgctggtattcttcattccatccctttcccctattcctaaatgtgctccagggacaatggggaagctggagcacatataagaataggggaaagagagggaataaaagggtattaaaaactctcaaggtatgttaaaaaaaagactctcaacaaaccaggtattgaaggaacatacctcaaaataataagagccatctatgatgaacccacagccaacatcacactgaataggcaaaagctggaaggatgccccttgaaaaccggcacaagacaaggctgccttctctcaccactcctattcaccatactattggaagtcctggccagagcaatcaggcaagagaaagaaagaaaaggcatccaagaaggaagagaggaagtcaaactacccatgtttgcagatgacataattttatatctagaaaatcccacagtctcagcccaaaagctccttaagctgataaacttcagaaagtttcaggatcccacatgaacatacaaaaatcactagtattcctaaacaccaaccatagctaagccaagagccaaatcaggaatgcaatcccattcacagacaaactgctaaaagcaaaaccaaaactttccaaataagccaggctttcgtcagttcctcagaactagttctggtttgactcactctcatgttacggcaaaccttaagctgaatgaacaact

The invention claimed is:

1. A method for treating a human subject afflicted with a malignant disease, comprising administering to the subject an effective amount of a pharmaceutical compound that interacts with Programmed cell death protein 1 (PDCD1), wherein the pharmaceutical compound is an antibody that specifically binds to PDCD1, wherein DNA methylation in a promoter region of the CD274 gene in cells of the malignant disease and/or T lymphocytes interacting with the cells of the malignant disease is known, from a DNA methylation analysis of a sample of the subject's cells of the malignant disease and/or T lymphocytes interacting with the cells of the malignant disease, to be less than that of a reference value.

2. The method of claim 1, wherein the pharmaceutical compound blocks binding of CD274 or PDCD1LG2 to PDCD1.

3. The method of claim 1, wherein the pharmaceutical compound is selected from the group consisting of nivolumab, pidilizumab, pembrolizumab, and any combination thereof.

4. The method of claim 1, wherein the pharmaceutical compound is pembrolizumab.

5. The method of claim 1, wherein the malignant disease is a carcinoma, a melanoma, a leukemia, a glioma, a sarcoma or a lymphoma.

6. The method of claim 5, wherein the carcinoma is a squamous cell carcinoma or an adenocarcinoma.

7. The method of claim 5, wherein the melanoma is metastasized.

8. A method for treating malignant melanoma in a human subject, comprising administering to the subject an effective amount of a pharmaceutical compound that interacts with Programmed cell death protein 1 (PDCD1), wherein the pharmaceutical compound is an antibody that specifically binds to PDCD1, wherein DNA methylation in a promoter region of the CD274 gene in cells of the malignant melanoma and/or T lymphocytes interacting with the cells of the malignant melanoma is known, from a DNA methylation analysis of a sample of the subject's cells of the malignant melanoma and/or T lymphocytes interacting with the cells of the malignant melanoma, to be less than that of a reference value.

9. The method of claim 8, wherein the pharmaceutical compound blocks binding of CD274 or PDCD1LG2 to PDCD1.

10. The method of claim 8, wherein the pharmaceutical compound is selected from the group consisting of nivolumab, pidilizumab, pembrolizumab, and any combination thereof.

11. The method of claim 8, wherein the pharmaceutical compound is pembrolizumab.

12. A method for treating malignant melanoma in a human subject, comprising administering to the subject an effective amount of an anti-Programmed cell death protein 1 (PDCD1) antibody, wherein DNA methylation in a promoter region of the CD274 gene in cells of the malignant melanoma and/or T lymphocytes interacting with the cells of the malignant melanoma is known, from a DNA methylation analysis of a sample of the subject's cells of the malignant melanoma and/or T lymphocytes interacting with the cells of the malignant melanoma, to be less than that of a reference value.

13. The method of claim 12, wherein the anti-PDCD1 antibody is selected from the group consisting of nivolumab, pidilizumab, pembrolizumab, and any combination thereof.

14. The method of claim 13, wherein the anti-PDCD1 antibody is pembrolizumab.

* * * * *